US012433938B2

(12) United States Patent
Voegtli et al.

(10) Patent No.: US 12,433,938 B2
(45) Date of Patent: Oct. 7, 2025

(54) ALKALINE PHOSPHATASE POLYPEPTIDES AND METHODS OF USE THEREOF

(71) Applicant: Alexion Pharmaceuticals, Inc., Boston, MA (US)

(72) Inventors: Walter C. Voegtli, Killingworth, CT (US); Michael Baranello, Boston, MA (US); Keith Bouchard, Boston, MA (US)

(73) Assignee: Alexion Pharmaceuticals, Inc., Boston, MA (US)

( * ) Notice: Subject to any disclaimer, the term of this patent is extended or adjusted under 35 U.S.C. 154(b) by 273 days.

(21) Appl. No.: 17/117,099

(22) Filed: Dec. 9, 2020

(65) Prior Publication Data

US 2021/0169994 A1     Jun. 10, 2021

Related U.S. Application Data

(60) Provisional application No. 62/945,431, filed on Dec. 9, 2019.

(51) Int. Cl.
| | | |
|---|---|---|
| A61K 38/46 | (2006.01) | |
| A61K 9/00 | (2006.01) | |
| A61K 47/02 | (2006.01) | |
| A61P 19/08 | (2006.01) | |
| C12N 9/16 | (2006.01) | |

(52) U.S. Cl.
CPC .......... *A61K 38/465* (2013.01); *A61K 9/0019* (2013.01); *A61K 47/02* (2013.01); *A61P 19/08* (2018.01); *C12N 9/16* (2013.01); *C12Y 301/03001* (2013.01); *C07K 2319/30* (2013.01)

(58) Field of Classification Search
CPC .... A61K 38/465; A61K 9/0019; A61K 47/02; A61P 19/08; C12N 9/16; C12Y 301/03001; C07K 2319/30; C07K 2319/20; C07K 2319/33
See application file for complete search history.

(56) References Cited

U.S. PATENT DOCUMENTS

| | | |
|---|---|---|
| 5,336,759 A | 8/1994 | Matsuo et al. |
| 5,338,830 A | 8/1994 | Matsuo et al. |
| 5,340,920 A | 8/1994 | Matsuo et al. |
| 5,352,770 A | 10/1994 | Matsuo |
| 5,428,130 A | 6/1995 | Capon et al. |
| 5,434,133 A | 7/1995 | Tanaka et al. |
| 5,583,108 A | 12/1996 | Wei et al. |
| 5,665,704 A | 9/1997 | Lowe et al. |
| 5,714,147 A | 2/1998 | Capon et al. |
| 5,767,239 A | 6/1998 | Immer et al. |
| 5,846,932 A | 12/1998 | Lowe et al. |
| 5,948,761 A | 9/1999 | Seilhamer et al. |
| 5,973,134 A | 10/1999 | Matsuo et al. |
| 6,020,168 A | 2/2000 | Matsuo et al. |
| 6,028,055 A | 2/2000 | Lowe et al. |
| 6,034,231 A | 3/2000 | Tanaka et al. |
| 6,290,952 B1 | 9/2001 | Poelstra et al. |
| 6,406,697 B1 | 6/2002 | Capon et al. |
| 6,407,211 B1 | 6/2002 | Burnett, Jr. et al. |
| 6,420,384 B2 | 7/2002 | Weigele et al. |
| 6,436,386 B1 | 8/2002 | Roberts et al. |
| 6,455,495 B1 | 9/2002 | Orgel et al. |
| 6,458,579 B2 | 10/2002 | Hopwood et al. |
| 6,525,022 B1 | 2/2003 | Lowe et al. |
| 6,541,610 B1 | 4/2003 | Smith |
| 6,743,425 B2 | 6/2004 | Nakao |
| 6,790,649 B1 | 9/2004 | Crine et al. |
| 6,818,619 B2 | 11/2004 | Burnett, Jr. et al. |
| 6,830,885 B1 | 12/2004 | Lanctot et al. |
| 6,849,714 B1 | 2/2005 | Bridon et al. |
| 6,887,470 B1 | 5/2005 | Bridon et al. |
| 6,905,689 B2 | 6/2005 | Schneidinger et al. |
| 6,946,484 B2 | 9/2005 | Adams et al. |
| 7,026,293 B2 | 4/2006 | Kitakaze |
| 7,033,997 B2 | 4/2006 | Forssmann et al. |
| 7,070,974 B1 | 7/2006 | Desgroseillers et al. |
| 7,105,539 B2 | 9/2006 | Gravel et al. |
| 7,112,341 B1 | 9/2006 | Nagarajan et al. |
| 7,179,903 B2 | 2/2007 | McArthur et al. |
| 7,256,253 B2 | 8/2007 | Bridon et al. |

(Continued)

FOREIGN PATENT DOCUMENTS

| | | |
|---|---|---|
| CA | 3161266 A1 | 6/2021 |
| CN | 103153344 A | 6/2013 |

(Continued)

OTHER PUBLICATIONS

An et al. (Nov. 2009). IgG2m4, an engineered antibody isotype with reduced Fc function. In MAbs (vol. 1, No. 6, pp. 572-579). Taylor & Francis. (Year: 2009).*
Komaru, K., Ishida-Okumura, Y., Numa-Kinjoh, N., Hasegawa, T., & Oda, K. (2019). Molecular and cellular basis of hypophosphatasia. Journal of oral biosciences, 61(3), 141-148. (Year: 2019).*
Sharma, U., Pal, D., & Prasad, R. (2014). Alkaline phosphatase: an overview. Indian Journal of Clinical Biochemistry, 29(3), 269-278. (Year: 2014).*
Di Mauro, S., Manes, T., Hessle, L., Kozlenkov, A., Pizauro JR, J. M., Hoylaerts, M. F., & Millán, J. L. (2002). Kinetic characterization of hypophosphatasia mutations with physiological substrates. Journal of Bone and Mineral Research, 17(8), 1383-1391. (Year: 2002).*

(Continued)

*Primary Examiner* — Melenie L Gordon
*Assistant Examiner* — Kimberly Breen
(74) *Attorney, Agent, or Firm* — Clark & Elbing LLP

(57) ABSTRACT

Featured are polypeptides that include soluble alkaline phosphatases, mutants, fragments, fusion proteins thereof, and methods of use thereof, for treating bone mineralization disorders, such as hypophosphatasia (HPP), and symptoms thereof. The polypeptides include a soluble alkaline phosphatase (sALP) or fragment thereof, which is derived from a naturally occurring alkaline phosphatase (ALP).

17 Claims, 40 Drawing Sheets
(31 of 40 Drawing Sheet(s) Filed in Color)
Specification includes a Sequence Listing.

(56) References Cited

U.S. PATENT DOCUMENTS

| | | |
|---|---|---|
| 7,271,149 B2 | 9/2007 | Glaesner et al. |
| 7,276,481 B2 | 10/2007 | Golembo et al. |
| 7,341,838 B2 | 3/2008 | Buechler et al. |
| 7,365,091 B2 | 4/2008 | Gravel et al. |
| 7,384,917 B2 | 6/2008 | Burnett, Jr. et al. |
| 7,399,466 B2 | 7/2008 | Boileau |
| 7,414,107 B2 | 8/2008 | Larsen |
| 7,425,531 B2 | 9/2008 | Lanctot et al. |
| 7,427,498 B2 | 9/2008 | Crine et al. |
| 7,470,668 B2 | 12/2008 | Lanctot et al. |
| 7,488,713 B2 | 2/2009 | Vesely |
| 7,527,939 B2 | 5/2009 | Davey et al. |
| 7,563,769 B2 | 7/2009 | Bogin et al. |
| 7,625,564 B2 | 12/2009 | Wang et al. |
| 7,642,243 B2 | 1/2010 | Nakao et al. |
| 7,648,962 B2 | 1/2010 | James et al. |
| 7,662,773 B2 | 2/2010 | James et al. |
| 7,678,391 B2 | 3/2010 | Graham et al. |
| 7,732,406 B2 | 6/2010 | Mitrovic et al. |
| 7,736,653 B2 | 6/2010 | Kim et al. |
| 7,754,852 B2 | 7/2010 | Burnett, Jr. et al. |
| 7,763,712 B2 | 7/2010 | Crine et al. |
| 7,803,769 B2 | 9/2010 | Sullivan et al. |
| 7,803,901 B2 | 9/2010 | Burnett, Jr. et al. |
| 7,825,092 B2 | 11/2010 | Vesely |
| 7,846,900 B2 | 12/2010 | Vesely |
| 7,858,560 B2 | 12/2010 | Koster et al. |
| 7,919,591 B2 | 4/2011 | Sheffer et al. |
| 7,943,126 B2 | 5/2011 | Tomatsu et al. |
| 7,960,529 B2 | 6/2011 | Crine et al. |
| 8,058,242 B2 | 11/2011 | Alewood et al. |
| 8,691,208 B2 | 4/2014 | Tomatsu et al. |
| 9,266,939 B2 | 2/2016 | Crine et al. |
| 9,650,412 B2 | 5/2017 | Konstantinov et al. |
| 9,650,413 B2 | 5/2017 | Konstantinov et al. |
| 9,908,932 B2 | 3/2018 | Malanson et al. |
| 9,988,620 B2 | 6/2018 | Crine et al. |
| 10,000,532 B2 | 6/2018 | Crine et al. |
| 10,052,366 B2 | 8/2018 | Crine et al. |
| 10,449,236 B2 | 10/2019 | Marozsan et al. |
| 10,603,361 B2 | 3/2020 | Odrljin |
| 10,988,744 B2 | 4/2021 | Rajendran et al. |
| 11,229,686 B2 | 1/2022 | Pradhan et al. |
| 11,352,612 B2 | 6/2022 | Jaluria et al. |
| 11,913,039 B2 | 2/2024 | Godawat et al. |
| 12,083,169 B2 | 9/2024 | Voegtli et al. |
| 2002/0183276 A1 | 12/2002 | Millan et al. |
| 2003/0158132 A1 | 8/2003 | Kovesdi |
| 2004/0023916 A1 | 2/2004 | Millan et al. |
| 2004/0077537 A1 | 4/2004 | Schreiner |
| 2004/0234518 A1 | 11/2004 | Crine et al. |
| 2005/0113286 A1 | 5/2005 | Schreiner et al. |
| 2005/0142217 A1 | 6/2005 | Adams et al. |
| 2005/0202442 A1 | 9/2005 | Morris et al. |
| 2005/0244904 A1 | 11/2005 | Ng |
| 2005/0276796 A1 | 12/2005 | Tomatsu et al. |
| 2006/0014687 A1 | 1/2006 | Crine et al. |
| 2006/0019890 A1 | 1/2006 | Kapoun et al. |
| 2006/0074009 A1 | 4/2006 | James et al. |
| 2006/0110359 A1 | 5/2006 | Sanchez-Ramos et al. |
| 2006/0172929 A1 | 8/2006 | Rappold-Hoerbrand et al. |
| 2006/0228710 A1 | 10/2006 | Morris et al. |
| 2007/0041972 A1 | 2/2007 | Rother et al. |
| 2007/0042957 A1 | 2/2007 | Burnett et al. |
| 2007/0081984 A1 | 4/2007 | Tomatsu et al. |
| 2007/0081986 A1 | 4/2007 | Tomatsu et al. |
| 2007/0197434 A1 | 8/2007 | Nakao et al. |
| 2007/0281887 A1 | 12/2007 | Pan |
| 2007/0292966 A1 | 12/2007 | Prickett et al. |
| 2007/0293418 A1 | 12/2007 | Larsen |
| 2008/0032933 A1 | 2/2008 | Burnett et al. |
| 2008/0081768 A1 | 4/2008 | Watt et al. |
| 2008/0085862 A1 | 4/2008 | Kim et al. |
| 2008/0113411 A1 | 5/2008 | Sheffer et al. |
| 2008/0113412 A1 | 5/2008 | Sheffer et al. |
| 2008/0125574 A1 | 5/2008 | Sheffer et al. |
| 2008/0153747 A1 | 6/2008 | Alewood et al. |
| 2008/0161243 A1 | 7/2008 | Rosen et al. |
| 2008/0181903 A1 | 7/2008 | Bhaskar et al. |
| 2008/0182299 A1 | 7/2008 | Colocaru et al. |
| 2008/0194481 A1 | 8/2008 | Rosen et al. |
| 2008/0194682 A1 | 8/2008 | Golembo et al. |
| 2008/0227713 A1 | 9/2008 | Protter |
| 2008/0293632 A1 | 11/2008 | Rappold-Hoerbrand et al. |
| 2008/0312142 A1 | 12/2008 | Nakao et al. |
| 2009/0011997 A1 | 1/2009 | Peri et al. |
| 2009/0022728 A1* | 1/2009 | Lin .................... 424/141.1 |
| 2009/0023652 A1 | 1/2009 | Bell et al. |
| 2009/0053192 A1 | 2/2009 | Millan et al. |
| 2009/0069243 A1 | 3/2009 | Burnett, Jr. et al. |
| 2009/0092582 A1 | 4/2009 | Bogin et al. |
| 2009/0142347 A1 | 6/2009 | Millan |
| 2009/0170756 A1 | 7/2009 | Burnett, Jr. et al. |
| 2009/0221803 A1 | 9/2009 | Dall'Acqua et al. |
| 2009/0238814 A1 | 9/2009 | Tomatsu et al. |
| 2009/0240031 A1 | 9/2009 | Immer et al. |
| 2009/0247462 A1 | 10/2009 | Bogin et al. |
| 2009/0252729 A1 | 10/2009 | Farrington et al. |
| 2009/0258018 A1 | 10/2009 | Medich et al. |
| 2009/0275506 A1 | 11/2009 | Bakis et al. |
| 2009/0325195 A1 | 12/2009 | Davey et al. |
| 2010/0008979 A1 | 1/2010 | Tomatsu et al. |
| 2010/0055150 A1 | 3/2010 | Golembo et al. |
| 2010/0093678 A1 | 4/2010 | Della-Fera et al. |
| 2010/0160212 A1 | 6/2010 | Sheffer et al. |
| 2010/0168443 A1 | 7/2010 | Geysen |
| 2010/0184680 A1 | 7/2010 | Bevec |
| 2010/0197574 A1 | 8/2010 | Chen et al. |
| 2010/0204094 A1 | 8/2010 | Simari et al. |
| 2010/0204109 A1 | 8/2010 | Bevec |
| 2010/0204446 A1 | 8/2010 | Forssmann |
| 2010/0209958 A1 | 8/2010 | Nakao et al. |
| 2010/0216714 A1 | 8/2010 | James et al. |
| 2010/0221234 A1 | 9/2010 | Crine et al. |
| 2010/0240125 A1 | 9/2010 | Crine et al. |
| 2010/0249017 A1 | 9/2010 | Bevec et al. |
| 2010/0260706 A1 | 10/2010 | Bogin et al. |
| 2010/0261248 A1 | 10/2010 | Kim et al. |
| 2010/0297021 A1 | 11/2010 | Wendt et al. |
| 2010/0297119 A1* | 11/2010 | Crine ............... A61K 39/395 424/134.1 |
| 2010/0305031 A1 | 12/2010 | Wakabayashi et al. |
| 2010/0305051 A1 | 12/2010 | Burnett, Jr. et al. |
| 2010/0310561 A1 | 12/2010 | Canada et al. |
| 2010/0311660 A1 | 12/2010 | Simari et al. |
| 2010/0317600 A1 | 12/2010 | Immer et al. |
| 2010/0331256 A1 | 12/2010 | Wendt et al. |
| 2011/0152194 A1 | 6/2011 | Burnett, Jr. et al. |
| 2011/0250187 A1 | 10/2011 | Tomatsu et al. |
| 2011/0269684 A1 | 11/2011 | Burnett, Jr. et al. |
| 2011/0300143 A1 | 12/2011 | Sly et al. |
| 2012/0088771 A1 | 4/2012 | Millan |
| 2012/0164142 A1 | 6/2012 | Crine et al. |
| 2013/0108635 A1 | 5/2013 | Crine et al. |
| 2013/0323244 A1 | 12/2013 | Crine et al. |
| 2014/0004096 A1 | 1/2014 | Nichols |
| 2014/0193388 A1 | 7/2014 | Velders et al. |
| 2014/0194484 A1 | 7/2014 | Coats et al. |
| 2015/0353633 A1 | 12/2015 | Kakkis et al. |
| 2016/0015784 A1* | 1/2016 | Shaw ................ A61K 38/19 |
| 2016/0052968 A1 | 2/2016 | Crine et al. |
| 2016/0097100 A1 | 4/2016 | Trent et al. |
| 2017/0175094 A1 | 6/2017 | Hatch |
| 2017/0360899 A1 | 12/2017 | Marozsan et al. |
| 2018/0072986 A1 | 3/2018 | Park et al. |
| 2018/0230445 A1 | 8/2018 | Jaluria et al. |
| 2019/0043501 A1 | 2/2019 | Ramaci |
| 2019/0099473 A1 | 4/2019 | Fujita et al. |
| 2020/0101141 A1 | 4/2020 | Moseley et al. |
| 2020/0121767 A1 | 4/2020 | Tomazos et al. |
| 2020/0224182 A1 | 7/2020 | Rajendran et al. |
| 2020/0306350 A1 | 10/2020 | Fujita et al. |
| 2021/0317425 A1 | 10/2021 | Godawat et al. |

(56) References Cited

U.S. PATENT DOCUMENTS

| | | | |
|---|---|---|---|
| 2022/0154155 A1 | 5/2022 | Godawat et al. | |
| 2023/0372456 A1 | 11/2023 | Petryk et al. | |
| 2024/0382568 A1 | 11/2024 | Voegtli et al. | |

FOREIGN PATENT DOCUMENTS

| | | |
|---|---|---|
| EP | 0478797 B1 | 4/1995 |
| EP | 0769554 A2 | 4/1997 |
| EP | 0466174 B1 | 6/1997 |
| EP | 0475394 B1 | 6/1997 |
| EP | 0466175 B1 | 1/1998 |
| EP | 0477971 B1 | 1/1998 |
| EP | 0475290 B1 | 12/1998 |
| EP | 0475291 B1 | 12/1998 |
| EP | 0497368 B1 | 6/2002 |
| EP | 1492567 | 9/2003 |
| EP | 1488802 A2 | 12/2004 |
| EP | 1502604 A1 | 2/2005 |
| EP | 1623994 A2 | 2/2006 |
| EP | 1759710 A1 | 3/2007 |
| EP | 0771875 B1 | 2/2008 |
| EP | 1985697 A1 | 10/2008 |
| EP | 2158319 A0 | 3/2010 |
| EP | 1759001 B1 | 4/2011 |
| EP | 2158319 B1 | 12/2011 |
| EP | 3250227 A2 | 12/2017 |
| JP | 8-70875 A | 3/1996 |
| JP | 2000-327583 A | 11/2000 |
| JP | 2002-541776 A | 12/2002 |
| JP | 2007-511209 A | 5/2007 |
| JP | 2007-533669 A | 11/2007 |
| JP | 2007-537725 A | 12/2007 |
| JP | 2010-501026 A | 1/2010 |
| JP | 2010-526543 A | 8/2010 |
| JP | 2010-530222 A | 9/2010 |
| JP | 2011-504506 A | 2/2011 |
| JP | 2015-502336 A | 1/2015 |
| JP | 2017-505128 A | 2/2017 |
| RU | 2708068 C2 | 12/2019 |
| WO | WO-92/20371 A1 | 11/1992 |
| WO | WO-94/20534 A1 | 9/1994 |
| WO | WO-95/05456 A1 | 2/1995 |
| WO | WO-95/13296 A1 | 5/1995 |
| WO | WO-95/33769 A1 | 12/1995 |
| WO | WO-98/17690 A1 | 4/1998 |
| WO | WO-98/35703 A2 | 8/1998 |
| WO | WO-99/46283 A1 | 9/1999 |
| WO | WO-00/18954 A2 | 4/2000 |
| WO | WO-00/50580 A2 | 8/2000 |
| WO | WO-00/53755 A2 | 9/2000 |
| WO | WO-00/64486 A2 | 11/2000 |
| WO | WO-00/69900 A2 | 11/2000 |
| WO | WO-01/36620 A2 | 5/2001 |
| WO | WO-01/44284 A2 | 6/2001 |
| WO | WO-01/80890 A2 | 11/2001 |
| WO | WO-02/15918 A2 | 2/2002 |
| WO | WO-02/47871 A1 | 6/2002 |
| WO | WO-02/067639 A1 | 8/2002 |
| WO | WO-02/068579 A2 | 9/2002 |
| WO | WO-02/074234 A2 | 9/2002 |
| WO | WO-03/074082 A1 | 9/2003 |
| WO | WO-03/079979 A2 | 10/2003 |
| WO | WO-03/092581 A2 | 11/2003 |
| WO | WO-03/094835 A2 | 11/2003 |
| WO | WO-2004/011498 A2 | 2/2004 |
| WO | WO-2004/022579 A2 | 3/2004 |
| WO | WO-2004/046194 A2 | 6/2004 |
| WO | WO-2004/047871 A2 | 6/2004 |
| WO | WO-2004/062555 A2 | 7/2004 |
| WO | WO-2004/074320 A2 | 9/2004 |
| WO | WO-2004/094460 A2 | 11/2004 |
| WO | WO-2005/000095 A2 | 1/2005 |
| WO | WO-2005/007809 A2 | 1/2005 |
| WO | WO-2005/042034 A1 | 5/2005 |
| WO | WO-2005/047337 A1 | 5/2005 |
| WO | WO-2005/070446 A1 | 8/2005 |
| WO | WO-2005/072055 A2 | 8/2005 |
| WO | WO-2005/087802 A2 | 9/2005 |
| WO | WO-2005/094890 A1 | 10/2005 |
| WO | WO-2005/098490 A1 | 10/2005 |
| WO | WO-2005/103263 A1 | 11/2005 |
| WO | WO-2005/105156 A1 | 11/2005 |
| WO | WO-2005/110435 A1 | 11/2005 |
| WO | WO-2006/005140 A2 | 1/2006 |
| WO | WO-2006/026663 A1 | 3/2006 |
| WO | WO-2006/039480 A2 | 4/2006 |
| WO | WO-2006/060641 A2 | 6/2006 |
| WO | WO-2006/110743 A1 | 10/2006 |
| WO | WO-2006/116260 A2 | 11/2006 |
| WO | WO-2007/041645 A2 | 4/2007 |
| WO | WO-2007/071295 A1 | 6/2007 |
| WO | WO-2007/097923 A2 | 8/2007 |
| WO | WO-2007/130113 A2 | 11/2007 |
| WO | WO-2008/021872 A1 | 2/2008 |
| WO | WO-2008/030558 A2 | 3/2008 |
| WO | WO-2008/031045 A2 | 3/2008 |
| WO | WO-2008/053362 A2 | 5/2008 |
| WO | WO-2008/058016 A2 | 5/2008 |
| WO | WO-2008/079995 A2 | 7/2008 |
| WO | WO-2008/088422 A2 | 7/2008 |
| WO | WO-2008/109903 A1 | 9/2008 |
| WO | WO-2008/133511 A2 | 11/2008 |
| WO | WO-2008/136611 A1 | 11/2008 |
| WO | WO-2008/138131 A1 | 11/2008 |
| WO | WO-2008/154226 A1 | 12/2008 |
| WO | WO-2009/006520 A1 | 1/2009 |
| WO | WO-2009/015011 A1 | 1/2009 |
| WO | WO-2009/023270 A2 | 2/2009 |
| WO | WO-2009/006732 A9 | 3/2009 |
| WO | WO-2009/033680 A2 | 3/2009 |
| WO | WO-2009/033724 A1 | 3/2009 |
| WO | WO-2009/033796 A1 | 3/2009 |
| WO | WO-2009/033807 A2 | 3/2009 |
| WO | WO-2009/034134 A2 | 3/2009 |
| WO | WO-2009/036448 A2 | 3/2009 |
| WO | WO-2009/040030 A1 | 4/2009 |
| WO | WO-2009/040031 A2 | 4/2009 |
| WO | WO-2009/040083 A2 | 4/2009 |
| WO | WO-2009/046861 A1 | 4/2009 |
| WO | WO-2009/058322 A1 | 5/2009 |
| WO | WO-2009/067639 A2 | 5/2009 |
| WO | WO-2009/086126 A2 | 7/2009 |
| WO | WO-2009/090553 A2 | 7/2009 |
| WO | WO-2009/142307 A1 | 11/2009 |
| WO | WO-2009/149161 A9 | 12/2009 |
| WO | WO-2009/156481 A1 | 12/2009 |
| WO | WO-2009/158035 A2 | 12/2009 |
| WO | WO-2010/002583 A2 | 1/2010 |
| WO | WO-2010/011096 A2 | 1/2010 |
| WO | WO-2010/048308 A2 | 4/2010 |
| WO | WO-2010/078325 A2 | 7/2010 |
| WO | WO-2010/082804 A2 | 7/2010 |
| WO | WO-2010/117760 A2 | 10/2010 |
| WO | WO-2010/129655 A2 | 11/2010 |
| WO | WO-2010/135541 A2 | 11/2010 |
| WO | WO-2011/130229 A1 | 10/2011 |
| WO | WO-2011/134084 A1 | 11/2011 |
| WO | WO-2012/088608 A1 | 7/2012 |
| WO | WO-2012/099851 A2 | 7/2012 |
| WO | WO 2013/058833 * | 4/2013 |
| WO | WO-2013/058833 A1 | 4/2013 |
| WO | WO-2013/059491 A1 | 4/2013 |
| WO | WO-2013/071262 A1 | 5/2013 |
| WO | WO-2015/112015 A1 | 7/2015 |
| WO | WO-2015/112017 A1 | 7/2015 |
| WO | WO-2016/007873 A1 | 1/2016 |
| WO | WO-2016/090251 A1 | 6/2016 |
| WO | WO-2016/123342 A2 | 8/2016 |
| WO | WO-2016/153191 A1 | 9/2016 |
| WO | WO-2017/031114 A1 | 2/2017 |
| WO | WO-2017/058822 A1 | 4/2017 |
| WO | WO-2017/074466 A1 | 5/2017 |
| WO | WO-2017/155569 A1 | 9/2017 |
| WO | WO-2017/171871 A1 | 10/2017 |

(56) References Cited

FOREIGN PATENT DOCUMENTS

| WO | WO-2017/173395 A1 | 10/2017 |
| WO | WO-2017/173413 A1 | 10/2017 |
| WO | WO-2017/214130 A1 | 12/2017 |
| WO | WO-2018/004517 A1 | 1/2018 |
| WO | WO-2018/035420 A1 | 2/2018 |
| WO | WO-2018/164995 A1 | 9/2018 |
| WO | WO-2019/164978 A1 | 8/2019 |
| WO | WO-2019/183208 A1 | 9/2019 |
| WO | WO-2019/190752 A1 | 10/2019 |
| WO | WO-2020/247421 A1 | 12/2020 |
| WO | WO-2021/119218 A1 | 6/2021 |

OTHER PUBLICATIONS

Komaru K, Ishida-Okumura Y, Numa-Kinjoh N, Hasegawa T, Oda K. Molecular and cellular basis of hypophosphatasia. J Oral Biosci. Sep. 2019;61(3):141-148. doi: 10.1016/j.job.2019.07.003. Epub Aug. 8, 2019. PMID: 31400546. (Year: 2019).*

Clustal Omega (2023) was used to obtain the multiple sequence alignments provided in the office action appendix. The alignments were retrieved on Jan. 10, 2025 and Jan. 8, 2025 from https://www.ebi.ac.uk/jdispatcher/msa/clustalo (Year: 2025).*

International Search Report and Written Opinion for International Patent Application No. PCT/US20/64140, mailed Apr. 23, 2021 (16 pages).

Kishnani et al., "Five-year efficacy and safety of asfotase alfa therapy for adults and adolescents with hypophosphatasia," Bone. 121:149-162 (2019).

Alexion Pharmaceuticals, "Safety Study of Human Recombinant Tissue Non-Specific Alkaline Phosphatase Fusion Protein Asfotase Alfa in Adults With Hypophosphatasia (HPP)," ClinicalTrials.gov. NCT00739505, <https://www.clinicaltrials.gov/ct2/show/NCT00739505>, last updated Mar. 29, 2019 (8 pages).

Alexion Pharmaceuticals, "Safety and Efficacy Study of Asfotase Alfa in Adolescents and Adults With Hypophosphatasia (HPP)," ClinicalTrials.gov. NCT01163149, <https://clinicaltrials.gov/ct2/show/NCT01163149>, last updated Mar. 13, 2019 (9 pages).

Alexion Pharmaceuticals, "Strensiq™ (asfotase alfa) for injection," retrieved from <globalgenes.org/2015/11/05/alexion-announces-fda-approval-for--strensiq/?gclid=CjwKCAjwwqaGBhBKEiwAMk-FtFQOKvuVN-WmNcDVyu9Q9X3f6QB-VOTwo0x216TR2H4_Qc6jSIhvxoCILMQAvD_BWE>, dated Nov. 5, 2015 (1 page).

European Medicines Agency, "Strensiq: Asfotase Alfa," <www.ema.europa.eu/en/medicines/human/EPAR/strensiq>, last updated Mar. 25, 2021 (8 pages).

Hofmann et al., "Efficacy and safety of asfotase alfa in infants and young children with hypophosphatasia: a phase 2 open-label study," J Clin Endocrinol Metab. 104(7): 2735-2747 (2019) (14 pages).

Kim et al., "CHO cells in biotechnology for production of recombinant proteins: current state and further potential," Appl Microbiol Biotechnol. 93(3):917-30 (2012).

McCormack et al., "Is bigger better? An argument for very low starting doses," CMAJ. 183(1):65-9 (2011).

Rush, "Childhood hypophosphatasia: to treat or not to treat," Orphanet J Rare Dis. 13(1):116 (2018) (5 pages).

Phillips et al., "Clinical Outcome Assessments: Use of Normative Data in a Pediatric Rare Disease," Value Health. 21(5):508-514 (2018).

"Effects of feeding strategy on CHO cell performance in fed-batch cultures using HyClone ActiPro medium and Cell Boost 7a and 7b supplements," Cytiva, <http://www.processdevelopmentforum.com/posters/effects-of-feeding-strategy-on-cho-cell-performance-in-fed-batch-cultures/>. 2017 (5 pages).

Witkowski et al., "Conversion of a beta-ketoacyl synthase to a malonyl decarboxylase by replacement of the active-site cysteine with glutamine," Biochemistry. 38(36):11643-50 (1999).

Whisstock et al., "Prediction of protein function from protein sequence and structure," Q Rev Biophys. 36(3):307-40 (2003).

Fu-Hang et al., "Preliminary study on the effect of Zn2+ on the activities of peptidase and alkaline phosphatase," Marine Sciences. 27(3):64-65 (2003).

Office Action for Chinese Patent Application No. 201680048588.5, mailed Jan. 18, 2021 (13 pages).

Dutta et al., "Men and mice: Relating their ages," Life Sci. 152:244-8 (2015).

Zhang et al., "Engineering E. coli Alkaline Phosphatase Yields Changes of Catalytic Activity, Thermal Stability and Phosphate Inhibition," Biocatal Biotransfor. 20(6):381-389 (2002).

Nangia et al., "Disorders of Calcium Metabolism in Newborns," Journal of Neonatology. 17(2):43-49 (2003).

Kochanowski et al., "Medium and feed optimization for fed-batch production of a monoclonal antibody in CHO cells," BMC Proc. 5(Suppl 8):P75 (2011) (3 pages).

"Xcellerex™ XDR cell culture bioreactor systems," GE Healthcare Life Sciences, retrieved from <https://www.cytivallifesciences.co.jp/catalog/pdf/29092925AA.pdf>, published Feb. 2014 (4 pages).

Yagasaki et al., "Animal Cell Technology: Basic & Applied Aspects," Proceedings of the Fifteenth Annual Meeting of the Japanese Association for Animal Cell Technology (JAACT), vol. 13, Fuchu, Nov. 11-15, 2002 (461 pages).

Kozlenkov et al., "Residues determining the binding specificity of uncompetitive inhibitors to tissue-nonspecific alkaline phosphatase," J Bone Miner Res. 19(11):1862-72 (2004).

NCBI Protein Database Accession No. NM_000478, retrieved on Feb. 23, 2021 (7 pages).

Pradhan et al., "Exposure-Response Modeling and Simulation to Support Evaluation of Efficacious and Safe Exposure and Dose Range for Asfotase alfa in Patients with Hypophosphatasia," ASBMR 2015 Annual Meeting Abstracts. J Bone and Med Res. SU0380:S316 (2015) (1 page).

Abbruzzese, L., "The Tinetti Performance-Oriented Mobility Assessment Tool," Am J Nursing. 98(12):16J-16L (1998) (3 pages).

International Search Report and Written Opinion for International Patent Application No. PCT/US20/64140, mailed Apr. 23, 2021 (70 pages).

Ali et al., "Isolation and characterization of calcifying matrix vesicles from epiphyseal cartilage," Proc Natl Acad Sci USA. 67(3):1513-20 (1970).

Anderson et al., "Pyrophosphate stimulation of calcium uptake into cultured embryonic bones. Fine structure of matrix vesicles and their role in calcification," Dev Biol. 34:211-227 (1973).

Anderson et al., "Sustained osteomalacia of long bones despite major improvement in other hypophosphatasia-related mineral deficits in tissue nonspecific alkaline phosphatase/nucleotide pyrophosphatase phosphodiesterase 1 double-deficient mice," Am J Pathol. 166(6):1711-1720 (2005).

Anderson et al., "The role of matrix vesicles in growth plate development and biomineralization," Front Biosci. 10:822-37 (2005).

Beertsen et al., "Root development in mice lacking functional tissue non-specific alkaline phosphatase gene: Inhibition of acellular cementum formation," J Dent Res. 78(6):1221-1229 (1999) (10 pages).

Bennett et al., "Extracellular domain-IgG fusion proteins for three human natriuretic peptide receptors," J Biol Chem. 266(34):23060-23067 (1991).

Bernard, "Ultrastructural localization of alkaline phosphatase in initial intramembranous osteogenesis," Clin Orthop Relat Res. 135:218-225 (1978).

Bonilla, "Pharmacokinetics of immunoglobulin administered via intravenous or subcutaneous routes," Immunol Allergy Clin N Am. 28:803-819 (2008).

Byers et al., "Effect of enzyme replacement therapy on bone formation in a feline model of mucopolysaccharidosis type VI," Bone. 21(5):425-431 (1997).

Cameron et al., "Minireview: Natriuretic peptides during development of the fetal heart and circulation," Endocrinology. 144(6):2191-2194 (2003).

Clemens et al., "Pharmacokinetics and biological actions of subcutaneously administered human brain natriuretic peptide," J Pharmacol Exp Ther. 287(1):67-71 (1998).

Declaration of Dr. Philippe Crine for European Patent Application No. 08757088.3, executed Jan. 14, 2011 (6 pages).

(56) References Cited

OTHER PUBLICATIONS

Engel et al., "Characterization of the hormone binding site of natriuretic peptide receptor-C," FEBS Lett. 360:169-172 (1995).
Extended European Search Report for European Application No. 08757088.3, dated Jun. 21, 2010 (6 pages).
Farley et al., "Effects of tunicamycin, mannosamine, and other inhibitors of glycoprotein processing on skeletal alkaline phosphatase in human osteoblast-like cells," Calcif Tissue Int. 76:63-74 (2005).
Fedde et al., "Alkaline phosphatase knock-out mice recapitulate the metabolic and skeletal defects of infantile hypophosphatasia," available in PMC Mar. 7, 2011, published in final edited form as: J Bone Miner Res. 14(12):2015-2026 (1999) (19 pages).
Garg, "Investigation of the role of FcRn in the absorption, distribution, and elimination of monoclonal antibodies," Dissertation: State University of New York at Buffalo, 2007 (Abstract only) (2 pages).
Greenberg et al., "A homoallelic Gly$^{317}$ to Asp mutation in ALPL causes the perinatal (lethal) form of hypophosphatasia in Canadian Mennonites," Genomics. 17:215-217 (1993).
Harmey et al., "Concerted regulation of inorganic pyrophosphate and osteopontin by Akp2, Enpp1, and Ank," Am J Pathol. 164(4):1199-1209 (2004).
Harmey et al., "Elevated skeletal osteopontin levels contribute to the hypophosphatasia phenotype in Akp2$^{-/-}$ mice," J Bone Miner Res. 21(9):1377-1386 (2006).
Hawrylak et al., "The solubilization of tetrameric alkaline phosphatase from human liver and its conversion into various forms by phosphatidylinositol phospholipase C or proteolysis," J Biol Chem. 263(28):14368-14373 (1988).
Henthorn et al., "Different missense mutations at the tissue-nonspecific alkaline phosphatase gene locus in autosomal recessively inherited forms of mild and severe hypophosphatasia," Proc Natl Acad Sci USA. 89:9924-9928 (1992).
Hessle et al., "Tissue-nonspecific alkaline phosphatase and plasma cell membrane glycoprotein-1 are central antagonistic regulators of bone mineralization," Proc Natl Acad Sci USA. 99(14): 9445-9449 (2002).
Jansonius, "Structure, evolution and action of vitamin B$_6$-dependent enzymes," Curr Opin Struct Biol. 8:759-769 (1998).
Jin et al., "Novel analog of atrial natriuretic peptide selective for receptor-A produces increased diuresis and natriuresis in rats," J Clin Invest. 98(4):969-976 (1996).
Johnson et al., "Matrix vesicle plasma cell membrane glycoprotein-1 regulates mineralization by murine osteoblastic MC3T3 cells," J Bone Miner Res. 14(6):883-892 (1999).
Kochendoerfer, "Protein & Peptide Drug Delivery—Third International Conference: Minimally invasive delivery methods, September 22-23, Philadelphia, PA, USA," IDrugs. 6(11):1043-5 (2003).
Kostenuik et al., "Infrequent delivery of a long-acting PTH-Fc fusion protein has potent anabolic effects on cortical and cancellous bone," J Bone Miner Res. 22(10):1534-1547 (2007).
Mahmood et al., "Selection of the first-time dose in humans: comparison of different approaches based on interspecies scaling of clearance," J Clin Pharmacol. 43:692-697 (2003).
Millán, *Mammalian Alkaline Phosphatases: From Biology to Applications in Medicine and Biotechnology*, Wiley-VCH Verlag Gmbh & Co., Weinheim, Germany (2006) (324 pages).
Morris et al., "Immunolocalization of alkaline phosphatase in osteoblasts and matrix vesicles of human fetal bone," Bone Miner. 19:287-298 (1992).
Nasu et al., "Aberrant interchain disulfide bridge of tissue-nonspecific alkaline phosphatase with an Arg433 to Cys substitution associated with severe hypophosphatasia," FEBS Journal. 273:5612-5624 (2006).
NCBI Protein Database Accession No. AAF64516, <www.ncbi.nlm.nih.gov/protein/AAF64516>, retrieved Apr. 16, 2013 (2 pages).
NCBI Protein Database Accession No. AAC33858, <www.ncbi.nlm.nih.gov/protein/AAC33858>, retrieved Apr. 16, 2013 (1 page).
NCBI Protein Database Accession No. AAH21289, <www.ncbi.nlm.nih.gov/protein/AAH21289>, retrieved Apr. 16, 2013 (2 pages).
NCBI Protein Database Accession No. AAH66116. Retrieved on Apr. 16, 2013 (2 pages).
NCBI Protein Database Accession No. AAH90861. Retrieved on Apr. 16, 2013 (2 pages).
NCBI Protein Database Accession No. AAI10910. Retrieved on Apr. 16, 2013 (2 pages).
NCBI Protein Database Accession No. AAI26166. Retrieved on Apr. 16, 2013 (2 pages).
NCBI Protein Database Accession No. AAI18209. Retrieved on Apr. 17, 2013 (2 pages).
NCBI Protein Database Accession No. AAN64273. Retrieved on Apr. 16, 2013 (1 page).
NCBI Protein Database Accession No. NP_000469. Retrieved on Apr. 16, 2013 (3 pages).
NCBI Protein Database Accession No. NP_001623. Retrieved on Apr. 16, 2013 (3 pages).
NCBI Protein Database Accession No. NP_001036028. Retrieved on Apr. 16, 2013 (2 pages).
NCBI Protein Database Accession No. NP_001253798, Retrieved on Apr. 17, 2013 (2 pages).
NCBI Protein Database Accession No. NP_112603. Retrieved on Apr. 16, 2013 (3 pages).
NCBI Protein Database Accession No. P05186. Retrieved on Apr. 16, 2013 (19 pages).
NCBI Protein Database Accession No. P05187. Retrieved on Apr. 16, 2013 (10 pages).
NCBI Protein Database Accession No. P08289. Retrieved on Apr. 16, 2013 (5 pages).
NCBI Protein Database Accession No. P09487. Retrieved on Apr. 16, 2013 (4 pages).
NCBI Protein Database Accession No. P09242. Retrieved on Apr. 16, 2013 (6 pages).
NCBI Protein Database Accession No. P09923. Retrieved on Apr. 16, 2013 (6 pages).
NCBI Protein Database Accession No. P10696. Retrieved on Apr. 16, 2013 (7 pages).
NCBI Protein Database Accession No. Q29486. Retrieved on Apr. 16, 2013 (3 pages).
NCBI Protein Database Accession No. Q9NOV0. Retrieved on Apr. 16, 2013 (1 page).
Nosjean et al., "Human tissue non-specific alkaline phosphatases: sugar-moiety-induced enzymic and antigenic modulations and genetic aspects," Biochem J. 321(Pt 2)(Pt 2):297-303 (1997).
Ramachandran et al., "Treatment of an anabolic bone deficiency in neurofibromatosis with bone morphogenetic proteins and its potential application for congenital pseudarthrosis of the tibia," J Bone Joint Surg Br. 91-B (Suppl. 1), Abstract 137 (2009).
Srinivas et al., "Assessment of dose proportionality, absolute bioavailability, and immunogenicity response of CTLA4Ig (BMS-188667), a novel immunosuppressive agent, following subcutaneous and intravenous administration to rats," Pharm Res. 14(7): 911-6 (1997).
Tye et al., "Delineation of the hydroxyapatite-nucleating domains of bone sialoprotein," J Biol Chem. 278(10):7949-7955 (2003).
Urlaub et al., "Deletion of the diploid dihydrofolate reductase locus from cultured mammalian cells," Cell. 33(2):405-412 (1983).
Wang et al., "A mouse model for achondroplasia produced by targeting fibroblast growth factor receptor 3," Proc Natl Acad Sci USA. 96(8):4455-4460 (1999).
Wang et al., "Structure-based chemical modification strategy for enzyme replacement treatment of phenylketonuria," Mol Genet Metab. 86(1-2):134-140 (2005).
Weiss et al., "A missense mutation in the human liver/bone/kidney alkaline phosphatase gene causing a lethal form of hypophosphatasia," Proc Natl Acad Sci USA. 85(20):7666-7669 (1988).
Whyte et al., "Enzyme-replacement therapy in life-threatening hypophosphatasia," N Engl J Med. 366(10):904-13 (2012).
Whyte et al., "Markedly increased circulating pyridoxal-5'-phosphate levels in hypophosphatasia," J Clin Invest. 76(2):752-756 (1985).
Wroblewski et al., "Pharmacokinetics, metabolic stability, and subcutaneous bioavailability of a genetically engineered analog of DcR3, FLINT [DcR3(R218Q)], in cynomolgus monkeys and mice," Drug Metab Dispos. 31(4):502-507 (2003).

(56) References Cited

OTHER PUBLICATIONS

Yamamoto et al., "Long term phenotypic correction of severe infantile hypophosphatasia in a mouse model by neonatal injection of lentiviral vector," Mol Ther. 17:S67-S68, Abstract 171 (2009) (2 pages).
Zierhut et al., "Population PK-PD model for Fc-osteoprotegerin in healthy postmenopausal women," J Pharmacokinet Pharmacodyn. 35(4):379-399 (2008).
Zurutuza et al., "Correlations of genotype and phenotype in hypophosphatasia," Hum Mol Genet. 8(6):1039-1046 (1999).
International Preliminary Report on Patentability for International Patent Application No. PCT/CA2011/050258, mailed Nov. 15, 2012 (9 pages).
International Search Report and Written Opinion for International Patent Application No. PCT/US2012/039004, mailed Nov. 2, 2012 (22 pages).
Invitation to Pay Additional Fees for International Patent Application No. PCT/US2012/039004, mailed Aug. 29, 2012 (2 pages).
Oikawa et al., "Enzyme replacement therapy on hypophosphatasia mouse model," J Inherit Metab Dis. 37(2):309-17 (2013).
Whyte et al., "Infantile hypophosphatasia: normalization of circulating bone alkaline phosphatase activity followed by skeletal remineralization. Evidence for an intact structural gene for tissue nonspecific alkaline phosphatase," J Pediatr. 108(1):82-8 (1986).
Achord et al., "Human beta-glucuronidase: in vivo clearance and in vitro uptake by a glycoprotein recognition system on reticuloendothelial cells," Cell 15(1):269-278 (1978).
Anderson et al., "Matrix vesicles in osteomalacic hypophosphatasia bone contain apatite-like mineral crystals," Am J Pathol. 151(6):1555-61 (1997).
Barton et al., "Replacement therapy for inherited enzyme deficiency—macrophage-targeted glucocerebrosidase for Gaucher's disease," N Engl J Med. 324(21):1464-70 (1991) (1 page) (Abstract only).
Bernardi, "Chromatography of proteins on hydroxyapatite," Methods Enzymol. 27:471-9 (1973).
Boskey et al., "Matrix vesicles promote mineralization in a gelatin gel," Calcif Tissue Int. 60(3):309-15 (1997).
Ciancaglini et al., "Contribution of matrix vesicles and alkaline phosphatase to ectopic bone formation," Braz J Med Biol Res. 39(5):603-10 (2006).
Crawley et al., "Enzyme replacement therapy in a feline model of Maroteaux-Lamy syndrome," J Clin Invest. 97(8):1864-73 (1996).
Di Mauro et al., "Kinetic characterization of hypophosphatasia mutations with physiological substrates," J Bone Miner Res. 17(8):1383-91 (2002).
Dumont et al., "Monomeric Fc fusions: impact on pharmacokinetic and biological activity of protein therapeutics," BioDrugs. 20(3):151-60 (2006).
Eng et al., "Safety and efficacy of recombinant human alpha-galactosidase A replacement therapy in Fabry's disease," N Engl J Med. 345(1):9-16 (2001).
Gilbert et al., "Chimeric peptides of statherin and osteopontin that bind hydroxyapatite and mediate cell adhesion," J Biol Chem. 275(21):16213-8 (2000).
Guo et al. "Protein tolerance to random amino acid change," Proc Natl Acad Sci USA. 101(25):9205-9210 (2004).
Henthorn et al., "Missense mutations of the tissue-nonspecific alkaline phosphatase gene in hypophosphatasia," Clin Chem. 38(12):2501-5 (1992).
Hosain et al., "Targeted delivery of antineoplastic agent to bone: biodistribution studies of technetium-99m-labeled gem-bisphosphonate conjugate of methotrexate," J Nucl Med. 37(1):105-7 (1996).
Kakkis et al., "Enzyme-replacement therapy in mucopolysaccharidosis I," N Engl J Med. 344(3):182-8 (2001).
Kaufmann et al., "Influence of low temperature on productivity, proteome and protein phosphorylation of CHO cells," Biotechnol Bioeng. 63(5):573-82 (1999).
Millán et al., "Enzyme replacement therapy for murine hypophosphatasia," J Bone Miner Res. 23(6):777-87 (2008).
Murray, "Lectin-specific targeting of lysosomal enzymes to reticuloendothelial cells," Methods Enzymol. 149:25-42 (1987).
Oda et al., "A general method for rapid purification of soluble versions of glycosylphosphatidylinositol-anchored proteins expressed in insect cells: an application for human tissue-nonspecific alkaline phosphatase," J Biochem. 126(4):694-9 (1999).
Pedersen et al., "Removal of N-terminal polyhistidine tags from recombinant proteins using engineered aminopeptidases," Protein Expr Purif. 15(3):389-400 (1999).
Salih et al., "Identification of the phosphorylated sites of metabolically $^{32}$P-labeled osteopontin from cultured chicken osteoblasts," J Biol Chem. 272(21):13966-73 (1997).
Sands et al., "Enzyme replacement therapy for murine mucopolysaccharidosis type VII," J Clin Invest. 93(6):2324-31 (1994).
Sekido et al., "Novel drug delivery system to bone using acidic oligopeptide: pharmacokinetic characteristics and pharmacological potential," J Drug Target. 9(2):111-21 (2001).
Sturtz et al., "A study of the delivery-targeting concept applied to antineoplasic drugs active on human osteosarcoma. I. Synthesis and biological activity in nude mice carrying human osteosarcoma xenografts of gem-bisphosphonic methotrexate analogues," Eur J Med Chemistry. 27:825-33 (1992).
Tomatsu, Declaration Under 37 C.F.R. § 1.132 for U.S. Appl. No. 11/484,870, dated Jun. 1, 2009 (3 pages).
Uludag et al., "Bone affinity of a bisphosphonate-conjugated protein in vivo," Biotechnol Prog. 16(6):1115-8 (2000).
Waymire et al., "Mice lacking tissue non-specific alkaline phosphatase die from seizures due to defective metabolism of vitamin B-6," Nat Genet. 11(1):45-51 (1995).
Weinberg, "An overview of infliximab, etanercept, efalizumab, and alefacept as biologic therapy for psoriasis," Clin Ther. 25(10):2487-505 (2003).
Weiss et al., "Isolation and characterization of a cDNA encoding a human liver/bone/kidney-type alkaline phosphatase," Proc Natl Acad Sci USA. 83(19):7182-6 (1986) (6 pages).
Weiss et al., "Structure of the human liver/bone/kidney alkaline phosphatase gene," J Biol Chem. 263(24):12002-10 (1988).
Weninger et al., "Biochemical and morphological effects of human hepatic alkaline phosphatase in a neonate with hypophosphatasia," Acta Paediatr Scand. Suppl. 360:154-160 (1989).
Whyte et al., "Infantile hypophosphatasia: enzyme replacement therapy by intravenous infusion of alkaline phosphatase-rich plasma from patients with Paget bone disease," J Pediatr. 101(3):379-86 (1982).
Whyte et al., "Enzyme replacement therapy for infantile hypophosphatasia attempted by intravenous infusions of alkaline phosphatase-rich Paget plasma: results in three additional patients," J Pediatr. 105(6):926-33 (1984).
Whyte et al., "Alkaline phosphatase: placental and tissue-nonspecific isoenzymes hydrolyze phosphoethanolamine, inorganic pyrophosphate, and pyridoxal 5'-phosphate. Substrate accumulation in carriers of hypophosphatasia corrects during pregnancy," J Clin Invest. 95(4):1440-5 (1995).
Whyte, "Hypophosphatasia," in The Metabolic and Molecular Bases of Inherited Disease (8th ed.), pp. 5313-5329, 2001 (McGraw-Hill Book Company) (epub pp. 1-41).
Whyte, Chapter 18: Heritable Forms of Rickets and Osteomalacia. *Connective Tissue and Its Heritable Disorders.* Wiley-Liss, Inc., eds. R.M. Royce and B. Steinmann, 765-87 (2002).
Whyte et al., "Marrow cell transplantation for infantile hypophosphatasia," J Bone Miner Res. 18(4):624-36 (2003).
Yamamoto et al., "Prolonged survival and phenotypic correction of Akp2$^{-/-}$ hypophosphatasia mice by lentiviral gene therapy," J Bone Miner Res. 26(1):135-42 (2011).
Communication from Examining Division for European Application No. 05739065.0, dated Jun. 18, 2009 (6 pages).
Communication from Examining Division for European Application No. 05739065.0, dated Jun. 11, 2010 (5 pages).
Office Action for U.S. Appl. No. 12/793,517, mailed Aug. 16, 2010 (9 pages).
Office Action for U.S. Appl. No. 13/071,445, mailed Feb. 6, 2012 (12 pages).

(56) References Cited

OTHER PUBLICATIONS

Supplementary European Search Report for European U.S. Appl. No. 05/739,065, mailed Dec. 2, 2008 (3 pages).
Choe et al., "Substrate profiling of cysteine proteases using a combinatorial peptide library identifies functionally unique specificities," J Biol Chem. 281(18):12824-12832 (2006).
Official Action and Translation for Japanese Application No. 2013-544989, mailed Oct. 27, 2015 (6 pages).
Harris, "The human alkaline phosphatases: what we know and what we don't know," Clin Chim Acta. 186:133-50 (1989).
De la Croix Ndong et al., "Asfotase-alpha improves bone growth, mineralization and strength in mouse models of neurofibromatosis type-1," Nat Med. 20(8):904-10 (2014) (10 pages).
International Search Report and Written Opinion for International Patent Application No. PCT/US2016/047166, mailed Nov. 7, 2016 (15 pages).
Ratner, "Alexion pays big for Synageva's rare disease drug candidate," Nat Biotechnol. 33(7):679 (2015).
Addison et al., "Pyrophosphate inhibits mineralization of osteoblast cultures by binding to mineral, up-regulating osteopontin, and inhibiting alkaline phosphatase activity," J Biol Chem. 282(21):15872-83 (2007).
Advisory Action for U.S. Appl. No. 11/484,870, mailed Dec. 20, 2007 (4 pages).
Altarescu et al., "The efficacy of enzyme replacement therapy in patients with chronic neuronopathic Gaucher's disease," J Pediatr. 138(4):539-547 (2001).
Anderson et al., "Impaired calcification around matrix vesicles of growth plate and bone in alkaline phosphatase-deficient mice," Am J Pathol. 164(3):841-7 (2004).
Barranger et al., "Lessons learned from the development of enzyme therapy for Gaucher disease," J Inherit Metab Dis. 24(Suppl. 2):89-96 (2001).
Bobé et al., "Fas-mediated liver damage in MRL hemopoietic chimeras undergoing Ipr-mediated graft-versus-host disease," J Immunol. 159:4197-4204 (1997).
Boskey, "Amorphous calcium phosphate: The contention of bone," J Dent Res. 76:1433-1436 (1997).
Campbell et al., "Insulin-like growth factor (IGF)-binding protein-5-(201-218) region regulates hydroxyapatite and IGF-I binding," Am J Physiol Endocrinol Metab. 273:E1005-1013 (1997).
Cleland et al., "Emerging protein delivery methods," Curr Opin Biotechnol. 12:212-219 (2001).
Communication from Examining Division for European Application No. 08757088.3, dated Apr. 20, 2011 (4 pages).
Data Sheet for pFUSE-SEAP-hFC "Plasmid designed for the expression of a SEAP-Fc Fusion protein," Invivogen, San Diego, CA (4 pages) (1989).
Extended European Search Report for European Application No. 11774253.6, dated Oct. 14, 2013 (8 pages).
Extended European Search Report for European Application No. 11000196.3, mailed Jun. 22, 2011 (6 pages).
Extended European Search Report for European Application No. 11004496.3, mailed Aug. 26, 2011 (7 pages).
Fujisaki et al., "Osteotropic Drug Delivery System (ODDS) based on bisphosphonic prodrug. IV effects of osteotropic estradiol on bone mineral density and uterine weight in ovariectomized rats," J Drug Target. 5(2):129-138 (1997) (11 pages).
Fujisawa et al., "Acidic amino acid-rich sequences as binding sites of osteonectin to hydroxyapatite crystals," Biochim Biophys Acta. 1292:53-60 (1996).
Furbish et al., "Uptake and distribution of placental glucocerebrosidase in rat hepatic cells and effects of sequential deglycosylation," Biochim Biophys Acta. 673:425-434 (1981).
Halling Linder et al., "Glycosylation differences contribute to distinct catalytic properties among bone alkaline phosphatase isoforms," available in PMC Nov. 1, 2010, published in final edited form as: Bone. 45(5):987-993 (2009) (17 pages).
Hardy et al., "Dissection of a carboxy-terminal region of the yeast regulatory protein RAP1 with effects on both transcriptional activation and silencing," Mol Cell Biol. 12(3):1209-1217 (1992).
Hult et al., "Engineered enzymes for improved organic synthesis," Curr Opin Biotechnol. 14:395-400 (2003).
Hunter et al., "Modulation of crystal formation by bone phosphoproteins: structural specificity of the osteopontin-mediated inhibition of hydroxyapatite formation," Biochem J. 300:723-728 (1994).
Ikezawa, "Glycosylphosphatidylinositol (GPI)-anchored proteins," Biol Pharm Bull. 25(4):409-17 (2002).
International Search Report and Written Opinion for International Patent Application No. PCT/CA2005/000615, mailed Aug. 18, 2005 (14 pages).
International Search Report and Written Opinion for International Patent Application No. PCT/CA2008/000923, mailed Sep. 12, 2008 (11 pages).
International Search Report and Written Opinion for International Patent Application No. PCT/CA2011/050258, mailed Jul. 29, 2011 (14 pages).
Kasugai et al., "Selective drug delivery system to bone: small peptide $(Asp)_6$ conjugation," J Bone Miner Res. 15(5):936-943 (2000).
Leone et al., "Allosteric modulation of pyrophosphatase activity of rat osseous plate alkaline phosphatase by magnesium ions," Int J Biochem Cell Biol. 30:89-97 (1998).
Meyer, "Can biological calcification occur in the presence of pyrophosphate?" Arch Biochem Biophys. 231(1):1-8 (1984).
Michigami et al., "Common mutations F310L and T1559del in the tissue-nonspecific alkaline phosphatase gene are related to distinct phenotypes in Japanese patients with hypophosphatasia," Eur J Pediatr. 164:277-282 (2005).
Moss et al., "Association of inorganic-pyrophosphatase activity with human alkaline-phosphatase preparations," Biochem J. 102:53-57 (1967).
Murshed et al., "Unique coexpression in osteoblasts of broadly expressed genes accounts for the spatial restriction of ECM mineralization to bone," Genes Dev. 19:1093-1104 (2005).
Narisawa et al., "Abnormal vitamin B6 metabolism in alkaline phosphatase knock-out mice causes multiple abnormalities, but not the impaired bone mineralization, " J Pathol. 193:125-133 (2001).
Narisawa et al., "Inactivation of two mouse alkaline phosphatase genes and establishment of a model of infantile hypophosphatasia," Dev Dyn. 208:432-446 (1997).
NCBI Protein Database Accession No. NP_001622. Retrieved on Apr. 16, 2013 (3 pages).
NCBI Protein Database Accession No. NP_031457. Retrieved on Apr. 16, 2013 (3 pages).
NCBI Protein Database Accession No. NP_037191. Retrieved on Apr. 16, 2013 (3 pages).
NCBI Protein Database Accession No. NP_776412. Retrieved on Apr. 17, 2013 (2 pages).
NCBI Protein Database Accession No. NP_789828. Retrieved on Apr. 16, 2013 (3 pages).
NCBI Protein Database Accession No. P01857. Retrieved on Apr. 18, 2013 (7 pages).
NCBI Protein Database Accession No. Q6PYX1. Retrieved on Oct. 15, 2013 (2 pages).
Ngo et al., Chapter 14: Computational Complexity, Protein Structure Prediction, and the Levinthal Paradox. *The Protein Folding Problem and Tertiary Structure Prediction*. Merz et al. (eds.), 433, 492-495 (1994).
Nishioka et al., "Enhancement of drug delivery to bone: characterization of human tissue-nonspecific alkaline phosphatase tagged with an acidic oligopeptide," Mol Genet Metab. 88:244-255 (2006).
Office Action for U.S. Appl. No. 11/111,664, mailed Dec. 4, 2008 (7 pages).
Office Action for U.S. Appl. No. 11/111,664, mailed May 14, 2008 (8 pages).
Office Action for U.S. Appl. No. 11/111,664, mailed Oct. 4, 2007 (11 pages).
Office Action for U.S. Appl. No. 11/484,870, mailed Aug. 11, 2009 (15 pages).

(56) References Cited

OTHER PUBLICATIONS

Office Action for U.S. Appl. No. 11/484,870, mailed Feb. 2, 2009 (16 pages).
Office Action for U.S. Appl. No. 11/484,870, mailed Jan. 25, 2007 (15 pages).
Office Action for U.S. Appl. No. 11/484,870, mailed Jul. 5, 2007 (13 pages).
Office Action for U.S. Appl. No. 11/484,870, mailed Jun. 25, 2008 (16 pages).
Office Action for U.S. Appl. No. 11/484,870, mailed Oct. 1, 2007 (12 pages).
Office Action for U.S. Appl. No. 12/405,920, mailed Aug. 9, 2010 (7 pages).
Office Action for U.S. Appl. No. 12/405,920, mailed Dec. 17, 2009 (14 pages).
Office Action for U.S. Appl. No. 13/071,445, mailed May 25, 2012 (14 pages).
Official Notification and Search Report for Eurasian Patent Application No. 201291138, dated Jul. 16, 2013 (3 pages).
Patti et al., "Critical residues in the ligand-binding site of the *Staphylococcus aureus* collagen-binding adhesin (Mscramm)," J Biol Chem. 270(20):12005-11 (1995).
Reply to Final Office Action for U.S. Appl. No. 13/071,445, dated Oct. 25, 2012 (14 pages).
Reply to Final Office Action for U.S. Appl. No. 11/111,664, dated Sep. 10, 2008 (32 pages).
Restriction Requirement for U.S. Appl. No. 12/599,679, mailed Jun. 12, 2012 (5 pages).
Rezende et al., "Inorganic pyrophosphate-phosphohydrolytic activity associated with rat osseous plate alkaline phosphatase," Cell Mol Biol. 44(2):293-302 (1998).
Rowe et al., "MEPE, a new gene expressed in bone marrow and tumors causing osteomalacia," Genomics. 67:54-68 (2000).
Russell et al., "Inorganic pyrophosphate in plasma in normal persons and in patients with hypophosphatasia, osteogenesis imperfecta, and other disorders of bone," J Clin Invest. 50:961-969 (1971).
Sharom et al., "Glycosylphosphatidylinositol-anchored proteins: structure, function, and cleavage by phosphatidylinositol-specific phospholipase C," Biochem Cell Biol. 80:535-549 (2002).
Shull et al., "Enzyme replacement in a canine model of Hurler syndrome," Proc Natl Acad Sci USA. 91:12937-12941 (1994).
Spears et al., "Deoxyuridylate effects on thymidylate synthase-5-fluorodeoxyuridylate-folate ternary complex formation," Biochem Pharmacol. 38(18):2985-2993 (1989).
Stahl et al., "Evidence for receptor-mediated binding of glycoproteins, glycoconjugates, and lysosomal glycosidases by alveolar macrophages," Proc Natl Acad Sci USA. 75(3):1399-1403 (1978).
Supplementary European Search Report for European Application No. 08757088, dated Jun. 7, 2010 (5 pages).
Symersky et al., "Structure of the collagen-binding domain from a Staphylococcus aureus adhesin," Nat Struct Biol. 4(10):833-838 (1997).
Tomatsu, Declaration Under 37 C.F.R. § 1.132 for U.S. Appl. No. 11/484,870, dated Nov. 27, 2007 (2 pages).
Whyte, "Hypophosphatasia and the role of alkaline phosphatase in skeletal mineralization," Endocr Rev. 15(4):439-461 (1994).
Whyte, "Chapter 70: Hypophosphatasia: Nature's window on alkaline phosphatase function in man," *Principles of Bone Biology*, 2nd ed., Bilezikian, Raisz, and Rodan. 2:1229-1248 (2002).
Yadav et al., "Dose response of bone-targeted enzyme replacement for murine hypophosphatasia," available in PMC Aug. 1, 2012, published in final edited form as: Bone. 49(2):250-6 (2011) (20 pages).
Yokogawa et al., "Selective delivery of estradiol to bone by aspartic acid oligopeptide and its effects on ovariectomized mice," Endocrinology. 142(3):1228-1233 (2001).
Young et al., "Structure, expression, and regulation of the major noncollagenous matrix proteins of bone," Clin Orthop Relat Res. 281:275-294 (1992).

Orimo, "The mechanism of mineralization and the role of alkaline phosphatase in health and disease," J Nippon Med Sch. 77(1):4-12 (2010).
Attwood, "The Babel of Bioinformatics," Science. 290(5491):471-3 (2000).
Skolnick et al., "From genes to protein structure and function: novel applications of computational approaches in the genomic era," Trends Biotechnol. 18(1):34-9 (2000).
Otsuka, "Neurofibromatosis type I," The Japanese Journal of Dermatology 115(6):843-7 (2005) (11 pages).
Bocciardi et al., "Overexpression of the C-type natriuretic peptide (CNP) is associated with overgrowth and bone anomalies in an individual with balanced t(2;7) translocation," Hum Mutat. 28(7):724-731 (2007).
Brenner et al., "Diverse biological actions of atrial natriuretic peptide," Physiol Rev. 70(3):665-699 (1990).
Chen et al., "Gly369Cys mutation in mouse FGFR3 causes achondroplasia by affecting both chondrogenesis and osteogenesis," J Clin Invest. 104(11):1517-1525 (1999).
Chusho et al., "Dwarfism and early death in mice lacking C-type natriuretic peptide," Proc Natl Acad Sci USA. 98(7):4016-4021 (2001).
Daggubati et al., "Adrenomedullin, endothelin, neuropeptide Y, atrial, brain, and C-natriuretic prohormone peptides compared as early heart failure indicators," Cardiovasc Res. 36:246-255 (1997).
De Plater et al., "The natriuretic peptide (OVCNP-39) from platypus (*Ornithorhynchus anatinus*) venom relaxes the isolated rat uterus and promotes oedema and mast cell histamine release," Toxicon. 36(6):847-857 (1998).
Furuya et al., "Structural requirements of C-type natriuretic peptide for elevation of cyclic GMP in cultured vascular smooth muscle cells," Biochem Biophys Res Commun. 183(3):964-969 (1992).
Hagiwara et al., "Autocrine regulation of rat chondrocyte proliferation by natriuretic peptide C and its receptor, natriuretic peptide receptor-B," J Biol Chem. 269(14):10729-10733 (1994).
Hagiwara et al., "cGMP produced in response to ANP and CNP regulates proliferation and differentiation of osteoblastic cells," Am J Physiol Cell Physiol. 270:C1311-18 (1996) (9 pages).
Horton et al., "Achondroplasia," Lancet. 370:162-72 (2007).
Inoue et al., "Four functionally distinct C-type natriuretic peptides found in fish reveal evolutionary history of the natriuretic peptide system," Proc Natl Acad Sci USA. 100(17):10079-10084 (2003).
International Search Report and Written Opinion for International Patent Application No. PCT/CA2011/050807, mailed Apr. 13, 2012 (18 pages).
International Search Report for International Patent Application No. PCT/US2012/060869, mailed Mar. 25, 2013 (5 pages).
Invitation to Pay Additional Fees for International Patent Application No. PCT/CA2011/050807, mailed Feb. 13, 2012 (2 pages).
Kalra et al., "The role of C-type natriuretic peptide in cardiovascular medicine," Eur Heart J. 22:997-1007 (2001).
Lo et al., "High level expression and secretion of Fc-X fusion proteins in mammalian cells," Protein Eng. 11(6):495-500 (1998).
Mericq et al., "Regulation of fetal rat bone growth by C-type natriuretic peptide and cGMP," Pediatr Res. 47(2):189-193 (2000) (9 pages).
Millan, Chapter 7: The in vivo role of TNAP. Mammalian alkaline phosphatases: From Biology to Applications in Medicine and Biotechnology. Wiley-VCH Verlag Gmbh & Co., 107-185 (2006).
Miyazawa et al., "Cyclic GMP-dependent protein kinase II plays a critical role in C-type natriuretic peptide-mediated endochondral ossification," Endocrinology. 143(9):3604-3610 (2002).
Nakao et al., "The pharmacokinetics of alpha-human atrial natriuretic polypeptide in healthy subjects," Eur J Clin Pharmacol. 31(1):101-103 (1986).
NCBI Protein Database Accession No. XP_001109717. Retrieved on Apr. 17, 2013 (1 page).
Pfeifer et al., "Intestinal secretory defects and dwarfism in mice lacking cGMP-dependent protein kinase II," Science. 274(5295):2082-2086 (1996).
Potter et al., "Natriuretic peptides, their receptors, and cyclic guanosine monophosphate-dependent signaling functions," Endocr Rev. 27(1):47-72 (2006).

(56) References Cited

OTHER PUBLICATIONS

Shukla et al., "RNA interference and inhibition of MEK-ERK signaling prevent abnormal skeletal phenotypes in a mouse model of craniosynostosis," Nat Genet. 39(9):1145-1150 (2007).
Suda et al., "C-type natriuretic peptide as an autocrine/paracrine regulator of osteoblast: evidence for possible presence of bone natriuretic peptide system," Biochem Biophys Res Commun. 223(1):1-6 (1996).
Takano et al., "Molecular evolution of shark C-type natriuretic peptides," Zoolog Sci. 11(3):451-454 (1994).
Tamura et al., "Critical roles of the guanylyl cyclase B receptor in endochondral ossification and development of female reproductive organs," Proc Natl Acad Sci USA. 101(49):17300-17305 (2004).
Teixeira et al., "Nitric oxide, C-type natriuretic peptide and cGMP as regulators of endochondral ossification," Dev Biol. 319(2):171-178 (2008).
Tsuji et al., "A loss-of-function mutation in natriuretic peptide receptor 2 (Npr2) gene is responsible for disproportionate dwarfism in cn/cn mouse," J Biol Chem. 280(14):14288-14292 (2005).
Wang et al., "Mice lacking Nf1 in osteochondroprogenitor cells display skeletal dysplasia similar to patients with neurofibromatosis type 1," Hum Mol Genet. 20(20):3910-3924 (2011).
Whyte, Chapter 207: Hypophosphatasia. *The Online Metabolic and Molecular Bases for Inherited Disease.* McGraw-Hill Book Company, Valle et al. (eds.) (2001) (41 pages).
Williams et al., "Solute transport in growth plate cartilage: In vitro and in vivo," Biophys J. 93(3):1039-1050 (2007).
Yasoda et al., "Natriuretic peptide regulation of endochondral ossification. Evidence for possible roles of the C-type natriuretic peptide/guanylyl cyclase-B pathway," J Biol Chem. 273(19):11695-11700 (1998).
Yasoda et al., "Systemic administration of C-type natriuretic peptide as a novel therapeutic strategy for skeletal dysplasias, " Endocrinology. 150(7):3138-3144 (2009).
Yoder et al., "Reduced ability of C-type natriuretic peptide (CNP) to activate natriuretic peptide receptor B (NPR-B) causes dwarfism in lbab$^{-/-}$ mice," Peptides. 29(9):1575-1581 (2008).
Farnum et al., "In vivo delivery of fluoresceinated dextrans to the murine growth plate: imaging of three vascular routes by multiphoton microscopy," available in PMC Oct. 28, 2008, published in final edited form as: Anat Rec A Discov Mol Cell Evol Biol. 288(1):91-103 (2006) (22 pages).
Husain et al., "Fc site-specific labeling of immunoglobulins with calf intestinal alkaline phosphatase," Bioconjug Chem. 5(5):482-90 (1994).
Mayer, "Chapter 4: Immunoglobulins: Structure and Function," *Microbiology and Immunology On-line*, University of South Carolina School of Medicine, <pathmicro.med.sc.edu/mayer/IgStruct2000.htm> (2009) (12 pages).
Yasoda et al., "Overexpression of CNP in chondrocytes rescues achondroplasia through a MAPK-dependent pathway," Nat Med. 10(1):80-86 (2004).
EBI Blast for Accession No. ATD17216. Entered Oct. 16, 2008 (1 page).
Supplementary European Search Report for European Patent Application No. 11853820.6, mailed Mar. 25, 2014 (3 pages).
International Preliminary Report on Patentability for International Patent Application No. PCT/US2012/060869, issued Apr. 22, 2014 (7 pages).
International Preliminary Report on Patentability for International Patent Application No. PCT/US2012/039004, issued Apr. 22, 2014 (8 pages).
Siris et al., "Paget's disease of bone," Trends Endocrinol Metab. 2(6):207-12 (1991).
Extended European Search Report for European Patent Application No. 12842640.0, dated Mar. 13, 2015 (7 pages).
Lee et al., "Disturbed osteoblastic differentiation of fibrous hamartoma cell from congenital pseudarthrosis of the tibia associated with neurofibromatosis type I," Clin Orthop Surg. 3(3):230-7 (2011).

Schindeler et al., "Modeling bone morphogenetic protein and bisphosphonate combination therapy in wild-type and Nf1 haploinsufficient mice," J Orthop Res. 26(1):65-74 (2008).
Nahabet et al., "Postnatal pancraniosynostosis in a patient with infantile hypophosphatasia," Cleft Palate Craniofac J. 53(6):741-4, doi: 10.1597/15-027 (2016).
International Search Report and Written Opinion for International Patent Application No. PCT/US2015/058498, mailed Jan. 22, 2016 (12 pages).
Kosnik-Infinger et al., "Enzyme replacement therapy for congenital hypophosphatasia allows for surgical treatment of related complex craniosynostosis: a case series," Neurosurg Focus. 38(5):E10 (2015) (8 pages).
Mornet et al., "Identification of fifteen novel mutations in the tissue-nonspecific alkaline phosphatase (TNSALP) gene in European patients with severe hypophosphatasia," Eur J Hum Genet. 6(4):308-14 (1998).
Alexion Pharma International, "Product Monograph, Including Patient Medication Information. Strensiq™ (asfotase alfa), Solution for Injection 40 mg/mL & 100 mg/mL," <alexionpharma.ca/documents/Strensiq-PM-asfotase-alfa-14Aug2015.aspx>, prepared Aug. 14, 2015 (32 pages).
Madson et al., "Asfotase alfa: sustained efficacy and tolerability in children with hypophosphatasia treated for 5 years," ESPE Abstracts. 84:FC2.4 (2015) (2 pages).
Center for Drug Evaluation and Research, "Application No. 125513Orig1s000," <www.accessdata.fda.gov/drugsatfda_docs/nda/2015/125513Orig1s000MedR.pdf>, review completed Oct. 20, 2015; retrieved on Jun. 1, 2016 (254 pages).
International Search Report and Written Opinion for International Patent Application No. PCT/US2016/025721, mailed Aug. 17, 2016 (18 pages).
Invitation to Pay Additional Fees for International Patent Application No. PCT/US2016/015366, mailed Jun. 1, 2016 (7 pages).
Phillips et al., "A modified performance-oriented mobility assessment tool for assessing clinically relevant gait impairments and change in children with hypophosphatasia: development and validation," 7th International Conference on Children's Bone Health, Jun. 27-30, Salzburg, Austria. Bone Abstracts. 4:P136 (2015) (2 pages).
Highlights of Prescribing Information for Strensiq™ (asfotase alfa) Injection, Alexion Pharmaceuticals, Inc., <www.alexion.com/Documents/strensiq_pi-Oct. 2015.aspx> (2015) (19 pages).
Phillips et al., "Gait assessment in children with childhood hypophosphatasia: impairments in muscle strength and physical function," The Endocrine Society's 97th Annual Meeting & Expo, Mar. 5-8, San Diego, California. Poster LBS-039 (2015) (2 pages).
"View of NCT02235493 on Nov. 19, 2015," ClinicalTrials.gov archive, updated Nov. 19, 2015, retrieved Jan. 27, 2017 (4 pages).
Hofmann et al., "Improvement in bone manifestations and respiratory status in infants and young children with HPP treated with asfotase alfa: an update on the ENB-010-10 trial," 7th International Conference on Children's Bone Health, Jun. 27-30, Salzburg, Austria. Bone Abstracts. 4:OC18 (2015) (3 pages).
Epps, "Application No. 125513Orig1s000 Medical Review(s)," Center for Drug Evaluation and Research, <www.accessdata.fda.gov/drugsatfda_docs/nda/2015/125513Orig1s000MedR.pdf>, Oct. 20, 2015 (254 pages).
International Search Report and Written Opinion for International Patent Application No. PCT/US2016/039595, mailed Feb. 21, 2017 (16 pages).
Liu et al., "Tissue-nonspecific alkaline phosphatase deficiency causes abnormal craniofacial bone development in the Alpl(-/-) mouse model of infantile hypophosphatasia," available in PMC Oct. 1, 2015, published in final edited form as: Bone. 67:81-94 (2014) (30 pages).
Appeal Brief as Filed in U.S. Appl. No. 12/638,527, dated Oct. 9, 2015 (101 pages).
Reply Brief as Filed in U.S. Appl. No. 12/638,527, dated Apr. 22, 2016 (4 pages).
Examiner's Answer to Appeal Brief for U.S. Appl. No. 12/638,527, mailed Feb. 23, 2016 (9 pages).

(56) References Cited

OTHER PUBLICATIONS

Phillips et al., "Significantly improved muscle strength, running speed, and agility in children with hypophosphatasia treated with asfotase alfa," Endocrine Society's 97th Annual Meeting and Expo, Mar. 5-8, San Diego, CA. Abstract OR29-4 (2015) (2 pages).

Millán et al., "Alkaline phosphatase and hypophosphatasia," Calcif Tissue Int. 98(4):398-416 (2016).

Kishnani et al., "Biochemical and physical function outcomes in adolescents and adults with hypophosphatasia treated with asfotase alfa for up to 4 years: interim results from a phase II study," Endocrine Society's 98th Annual Meeting and Expo, Apr. 1-4, Boston, MA. Abstract OR26-3 (2016) (2 pages).

International Search Report and Written Opinion for International Patent Application No. PCT/US2017/025590, mailed Jun. 29, 2017 (18 pages).

Iqbal et al., "Recurrent Metatarsal Fractures in Postmenopausal Woman With Low Serum Alkaline Phosphatase: A Rare Diagnosis Not to Miss," J Investig Med High Impact Case Rep. 5(3):1-3 (2017).

Ahn et al., "Idiopathic calcium pyrophosphate dihydrate (CPPD) crystal deposition disease in a young male patient: a case report," J Korean Med Sci. 18(6):917-20 (2003).

Cahill et al., "Infantile hypophosphatasia: transplantation therapy trial using bone fragments and cultured osteoblasts," J. Clin Endocrinol Metab. 92(8): 2923-30 (2007).

Glass et al., "The infant skull: a vault of information," Radiographics. 24(2):507-22 (2004).

Herasse et al., "Molecular study of three cases of odontohypophosphatasia resulting from heterozygosity for mutations in the tissue non-specific alkaline phosphatase gene," J Med Genet. 40(8):605-9 (2003).

Ishida et al., "Tissue-nonspecific alkaline phosphatase with an Asp(289)-->Val mutation fails to reach the cell surface and undergoes proteasome-mediated degradation," J Biochem. 134(1):63-70 (2003).

Mornet, "Hypophosphatasia," Orphanet J Rare Dis. 2:(40) (2007) (8 pages).

Spentchian et al., "Severe hypophosphatasia: characterization of fifteen novel mutations in the ALPL gene," Hum Mutat. 22(1) (2003) (5 pages).

Takinami et al., "The mutant (F310L and V365I) tissue-nonspecific alkaline phosphatase gene from hypophosphatasia," J Med Dent Sci. 51(1):67-74 (2004).

Sawai et al., "Severe perinatal hypophosphatasia due to homozygous deletion of T at nucleotide 1559 in the tissue nonspecific alkaline phosphatase gene," Prenat Diagn. 23(9):743-6 (2003).

Wickramasinghe et al., "A case of hypophosphatasia," Ceylon Med J. 48(3):94-5 (2003) (2 pages).

Yamamoto et al., "A successful treatment with pyridoxal phosphate for West syndrome in hypophosphatasia," Pediatr Neurol. 30(3):216-8 (2004).

International Preliminary Report on Patentability for International Patent Application No. PCT/US2016/015366, mailed Aug. 10, 2017 (10 pages).

International Search Report and Written Opinion for International Patent Application No. PCT/US2017/047527, mailed Nov. 6, 2017 (10 pages).

Millán et al., "Hypophosphatasia—pathophysiology and treatment," available in PMC Sep. 22, 2014, published in final edited form as: Actual Osteol. 8(3):164-182 (2012) (21 pages).

Padidela et al., "P1-118: Management of Tracheobronchomalacia During Asfotase Alfa Treatment in Infants with Perinatal-Onset Hypophosphatasia: A Case Series," European Society for Paediatric Endocrinology (ESPE), Paris, France, Sep. 10-12, 2016 (1 page).

Mornet et al., "Structural evidence for a functional role of human tissue nonspecific alkaline phosphatase in bone mineralization," J Biol Chem. 276(33):31171-8 (2001).

Bhattacharyya et al., "Hypophosphatasia and the risk of atypical femur fractures: a case-control study," BMC Muscoloskelet Disord. 17:332 (2016) (4 pages).

Bishop, "Asfotase alfa for hypophosphatasia," Horizon Scanning Centre. National Institute for Health Research. www.hsric.nihr.ac.uk/topics/asfotase-alfa-for-hypophosphatasia/download, retrieved Oct. 20, 2013 (9 pages).

Bishop et al., "Transformative therapy in hypophosphatasia," Arch Dis Child. 101(6):514-5 (2016).

Bishop, "Clinical management of hypophosphatasia," Clin Cases Miner Bone Metab. 12(2):170-3 (2015).

Durussel et al., "Bone mineralization-dependent craniosynostosis and craniofacial shape abnormalities in the mouse model of infantile hypophosphatasia," Dev Dyn. 245(2):175-82 (2016).

Braunstein, "Multiple fractures, pain, and severe disability in a patient with adult-onset hypophosphatasia," Bone Rep. 4:1-4 (2016).

Bloch-Zupan, "Hypophosphatasia: diagnosis and clinical signs—a dental surgeon perspective," Int J Paediatr Dent. 26(6):426-438 (2016).

Kishnani et al., "Monitoring guidance for patients with hypophosphatasia treated with asfotase alfa," Mol Genet Metab. 122(1-2):4-17 (2017).

Güzel Nur et al., "Pyridoxine-responsive seizures in infantile hypophosphatasia and a novel homozygous mutation in ALPL gene," J Clin Res Pediatr Endocrinol. 8(3):360-4 (2016).

Gasque et al., "Improvement of the skeletal and dental hypophosphatasia phenotype in Alpl-/- mice by administration of soluble (non-targeted) chimeric alkaline phosphatase," Available in PMC Mar. 1, 2016, published in final edited form as: Bone. 72:137-147 (2015) (25 pages).

Fodor et al., "Differencial diagnosis of the low alkaline phosphatase activities," Orv Hetil. 158(26):1003-1007 (2017) (Article in Hungarian) (English Abstract included).

McKiernan et al., "Clinical and radiographic findings in adults with persistent hypophosphatasemia," J Bone Miner Res. 29(7):1651-60 (2014).

Martos-Moreno et al., "Hypophosphatasia: clinical manifestations, diagnostic recommendations and therapeutic options," An Pediatr (Barc). S1695-4033(17)30223-0 (2017) (11 pages) (Article in Spanish) (English Abstract included).

Kulikova et al., "Hypophosphatasia: the clinical description of 3 cases of the disease with the molecular-genetic verification of the diagnosis," Problems of Endocrinology. 61(3):37-42 (2015) (Article in Russian) (English Abstract included).

Orimo, "Pathophysiology of hypophosphatasia and the potential role of asfotase alfa," Ther Clin Risk Manag. 12:777-86 (2016).

Morrow, "Expensive new biologic helps children fight hypophosphatasia," Manag Care. 24(12) (2015) (7 pages).

Mornet et al., "Hypophosphatasia," GeneReviews. www.ncbi.nlm.nih.gov/books/NBK1150/, retrieved Dec. 6, 2017, initially published Nov. 20, 2007, last updated Feb. 4, 2016 (25 pages).

Mori et al., "Case series: odontohypophosphatasia or missed diagnosis of childhood/adult-onset hypophosphatasia?—Call for a long-term follow-up of premature loss of primary teeth," Bone Rep. 5:228-232 (2016).

Remde et al., "Successful asfotase alfa treatment in an adult dialysis patient with childhood-onset hypophosphatasia," J Endoc Soc. 1(9):1188-93 (2017).

Panesar, "Hypophosphatasia: a rare disorder," US Pharm. 42(5) (2017) (8 pages).

Padidela et al., "Enzyme-replacement therapy in life-threatening perinatal hypophosphatasia in a premature infant," Endocrine Abstracts. 33:P9 (2013) (1 page).

Sotillo et al., "Signs and symptoms of hypophosphatasia," Dimensions of Dental Hygiene. 15(4):44-47 (2017) (6 pages).

Simm et al., "Successful use of enzyme replacement therapy in infantile hypophosphatasia," J Paediatr Child Health. 53(9):925-926 (2017).

Sheikh et al., "A newborn with no bones: neonatal hypophosphatasia with respiratory distress," J Pediatr. 188:306 (2017).

Saglam et al., "Clinical and genetic findings of Turkish hypophosphatasia cases," J Clin Res Pediatr Endocrinol. 9(3):229-236 (2017).

Whyte et al., "Asfotase alfa treatment improves survival for perinatal and infantile hypophosphatasia," J Clin Endocrinol Metab. 101(1):334-42 (2016) (17 pages).

(56) References Cited

OTHER PUBLICATIONS

Wang et al., "Current concepts in odontohypophosphatasia form of hypophosphatasia and report of two cases," BMC Oral Health. 16(1):70 (2016) (8 pages).
Taketani et al., "Ex vivo expanded allogeneic mesenchymal stem cells with bone marrow transplantation improved osteogenesis in infants with severe hypophosphatasia," Cell Transplant. 24(10):1931-43 (2015).
Belachew et al., "Infantile hypophosphatasia secondary to a novel compound heterozygous mutation presenting with pyridoxine-responsive seizures," JIMD Rep. 11:17-24 (2013).
Whyte et al., "Asfotase alfa therapy for children with hypophosphatasia," JCI Insight. 1(9):e85971 (2016) (11 pages).
Whyte, "Hypophosphatasia: enzyme replacement therapy brings new opportunities and new challenges," J Bone Miner Res. 32(4):667-675 (2017).
Alexion Third Quarter 2017 Earnings Call, "files.shareholder.com/downloads/ALXN/5636824573x0x961197/3B361D6E-80E2-463E-B0E5-3EAD7FC5B9D0/Alexion_Q3_2017_Earnings_Slides.pdf" (43 pages).
Urlaub et al., "Isolation of Chinese hamster cell mutants deficient in dihydrofolate reductase activity," Proc Natl Acad Sci U S A. 77(7):4216-20 (1980).
Graham et al., "Characteristics of a human cell line transformed by DNA from human adenovirus type 5," J Gen Virol. 36(1):59-72 (1977).
Mather, "Establishment and characterization of two distinct mouse testicular epithelial cell lines," Biol Reprod. 23(1):243-52 (1980).
Le Du et al., "Crystal structure of alkaline phosphatase from human placenta at 1.8 Å resolution. Implication for a substrate specificity," J Biol Chem. 276(12):9158-65 (2001) (9 pages).
Stec et al., "A revised mechanism for the alkaline phosphatase reaction involving three metal ions," J Mol Biol. 299(5):1303-11 (2000).
Alexion, "Highlights of Prescribing Information" for Strensiq®, 2018 (8 pages).
European Collection of Authenticated Cell Cultures (ECACC), General Cell Collection: NS0, Catalogue No. 85110503. Retrieved May 2, 2018 (3 pages).
UniProtKB Accession No. P05186. Retrieved May 2, 2018 (19 pages).
UniProtKB Accession No. P01857. Retrieved May 2, 2018 (13 pages).
Belkhouribchia et al., "Osteomalacia with low alkaline phosphatase: a not so rare condition with important consequences," BMJ Case Rep. doi: 10.1136/bcr-2015-212827 (2016) (4 pages).
Berkseth et al., "Clinical spectrum of hypophosphatasia diagnosed in adults," Bone. 54(1):21-7 (2013).
Bianchi, "Hypophosphatasia: an overview of the disease and its treatment," Osteoporos Int. 26(12):2743-57; DOI 10.1007/s00198-015-3272-1 (2015) (15 pages).
Bobryshev et al., "Role of bone-type tissue-nonspecific alkaline phosphatase and PHOSPO1 in vascular calcification," Curr Pharm Des. 20(37):5821-8 (2014).
Bowden et al., "Asfotase alfa treatment for 1 year in a 16 year-old male with severe childhood hypophosphatasia," Osteoporos Int. 29(2):511-5; DOI: 10.1007/s00198-017-4267-x (2018) (5 pages).
Briot et al., "Adult hypophosphatasia," Curr Opin Rheumatol. 28(4):448-51 (2016).
Buchet et al., "Chapter 3: Multisystemic functions of alkaline phosphatases," *Phosphatase Modulators, Methods in Molecular Biology*, vol. 1053. José Luis Millán (ed.), 27-51 (2013).
Deeb et al., "Could alerting physicians for low alkaline phosphatase levels be helpful in early diagnosis of hypophosphatasia?," J Clin Res Pediatr Endocrinol. 10(1):19-24 (2018).
Hofmann et al., "Chapter 15: Recombinant enzyme replacement therapy in hypophosphatasia," *Neuronal Tissue-Nonespecific Alkaline Phosphatase (TNAP): Subcellular Biochemistry*. Caroline Fonta and Laszlo Negyessy, 76:323-41 (2015).

Hofmann et al., "Asfotase alfa: enzyme replacement for the treatment of bone disease in hypophosphatasia," Drugs Today (Barc). 52(5):271-85 (2016).
Kitaoka et al., "Safety and efficacy of treatment with asfotase alfa in patients with hypophosphatasia: results from a Japanese clinical trial," Clin Endocrinol (Oxf). 87(1): 10-19 (epub pp. 1-10) (2017).
Linglart et al., "Hypophosphatasia," Curr Osteoporos Rep. 14(3):95-105; DOI 10.1007/s11914-016-0309-0 (2016) (11 pages).
Mornet, "Hypophosphatasia," Metabolism. 82:142-155; DOI: 10.1016/j.metabol.2017.08.013 (2018) (30 pages).
Mornet, "Chapter 2: Molecular genetics of hypophosphatasia and phenotype-genotype correlations," Subcell Biochem. 76:25-43 (2015).
Okazaki et al., "Lethal hypophosphatasia successfully treated with enzyme replacement from day 1 after birth," Eur J Pediatr. 175(3):433-7; DOI 10.1007/s00431-015-2641-2 (2016) (5 pages).
Park et al., "First Korean case of infantile hypophosphatasia with novel mutation in ALPL and literature review," Ann Clin Lab Sci. 46(3):302-7 (2016).
Phillips et al., "Physical therapy management of infants and children with hypophosphatasia, " Mol Genet Metab. 119(1-2):14-9 (2016).
Rockman-Greenberg, "Hypophosphatasia," Pediatr Endocrinol Rev. 10 Suppl 2:380-8 (2013) (Abstract only).
Rodriguez et al., "Respiratory mechanics in an infant with perinatal lethal hypophosphatasia treated with human recombinant enzyme replacement therapy," Pediatr Pulmonol. 47(9):917-22 (2012).
Saraff et al., "A diagnostic algorithm for children with low alkaline phosphatase activities: lessons learned from laboratory screening for hypophosphatasia," J Pediatr. 172:181-6 (2016) (7 pages).
Sather, "Case Study: 3 year old female with hypophosphatasia, treated with asfotase alfa replacement," J Pediatr Nurs. 34:104 (Abstract 008) (2017) (1 page).
Schmidt et al., "Hypophosphatasia: What is currently available for treatment?" Internist (Berl). 57(12):1145-1154 (2016) (Article in German) (English abstract).
Schmidt et al., "Clinical, radiographic and biochemical characteristics of adult hypophosphatasia," Osteoporos Int. 28(9):2653-2662 (2017).
Scott, "Asfotase alfa in perinatal/infantile-onset and juvenile-onset hypophosphatasia: a guide to its use in the USA," BioDrugs. 30(1):41-8 (2016).
Scott, "Asfotase alfa: a review in paediatric-onset hypophosphatasia," Drugs. 76(2):255-62 (2016).
Shapiro et al., "Hypophosphatasia in adults: clinical assessment and treatment considerations," J Bone Miner Res. 32(10):1977-1980 (2017).
Siller et al., "Alkaline phosphatase: discovery and naming of our favorite enzyme," J Bone Miner Res. 33(2):362-4 (2018).
Takahashi et al., "Parental serum alkaline phosphatase activity as an auxiliary tool for prenatal diagnosis of hypophosphatasia," Prenat Diagn. 37(5):491-6 (2017).
Tenorio et al., "Molecular and clinical analysis of ALPL in a cohort of patients with suspicion of hypophosphatasia," Am J Med Genet A. 173(3):601-10 (2017).
Tsiantouli et al., "Hypophosphatasia," Rev Med Suisse. 13(559):855-8 (2017) (Article in French) (English Abstract Included).
Weber et al., "Burden of disease in adult patients with hypophosphatasia: Results from two patient-reported surveys," Metabolism. 65(10):1522-30 (2016).
Whyte, "Hypophosphatasia—aetiology, nosology, pathogenesis, diagnosis and treatment," Nat Rev Endocrinol. 12(4):233-46 (2016).
Whyte, "Hypophosphatasia: an overview for 2017," Bone. 102:15-25 (2017).
Whyte et al., "Hypophosphatasia: natural history study of 101 affected children investigated at one research center," Bone. 93:125-138 (2016).
Whyte et al., "Hypophosphatasia: validation and expansion of the clinical nosology for children from 25 years experience with 173 pediatric patients," Bone. 75:229-39 (2015).
International Search Report and Written Opinion for International Patent Application No. PCT/US2016/054013, mailed Dec. 13, 2016 (19 pages).

(56) References Cited

OTHER PUBLICATIONS

Seefried et al., "Pharmacodynamic results from a phase 2a, randomized, multicenter, open-label, dose-ranging study of asfotase alfa in adults with pediatric hypophosphatasia," 100th Annual Meeting and Expo of the Endocrine Society, Mar. 17-20, 2018, Chicago, IL (1 page).
International Search Report and Written Opinion for International Patent Application No. PCT/US2018/020859, mailed Jun. 19, 2018 (14 pages).
López-Delgado et al., "Abnormal bone turnover in individuals with low serum alkaline phosphatase," Osteoporosis Int. 29(9):2147-2150; doi: 10.1007/s00198-018-4571-0 (Supplementary information included) (2018) (6 pages).
Matsumoto et al., "Rescue of severe infantile hypophosphatasia mice by AAV-mediated sustained expression of soluble alkaline phosphatase," Hum Gene Ther. 22(11):1355-64 (2011).
Hofmann et al., "Clinical aspects of hypophosphatasia: an update," Clinic Rev Bone Miner Metab. 11(2):60-70 (2013).
Taketani et al., "Clinical and genetic aspects of hypophosphatasia in Japanese patients," Arch Dis Child. 99(3):211-5 (2014) (6 pages).
Whyte, "Physiological role of alkaline phosphatase explored in hypophosphatasia," Ann N Y Acad Sci. 1192:190-200 (2010).
Hofmann et al., "Compound heterozygosity of two functional null mutations in the ALPL gene associated with deleterious neurological outcome in an infant with hypophosphatasia," Bone. 55:150-7 (2013).
De Roo et al., "Infantile hypophosphatasia without bone deformities presenting with severe pyridoxine-resistant seizures," Mol Genet Metab. 111(3):404-7 (2014).
International Search Report and Written Opinion for International Patent Application No. PCT/US2015/064003, mailed Mar. 31, 2016 (13 pages).
Lazdunski et al., "Structure-function relationships for some metalloalkaline phosphatases of *E. coli*," Eur J Biochem. 8(4):510-7 (1969).
Bobyr et al., "High-resolution analysis of Zn(2+) coordination in the alkaline phosphatase superfamily by EXAFS and x-ray crystallography," J Mol Biol. 415(1):102-17 (2012).
International Search Report and Written Opinion for International Patent Application No. PCT/US2017/036133, mailed Aug. 24, 2017 (10 pages).
International Search Report and Written Opinion for International Patent Application No. PCT/US2018/025206, mailed Jul. 3, 2018 (25 pages).
Kishnani et al., "OR26-3 Biochemical and Physical Function Outcomes in Adolescents and Adults with Hypophosphatasia Treated with Asfotase Alfa for up to 4 Years: Interim Results from a Phase II Study," ENDO 2016, Boston, MA, Apr. 3, 2016 (22 pages).
International Search Report and Written Opinion for International Patent Application No. PCT/US2017/025618, mailed Jul. 11, 2017 (22 pages).
Li et al., "Standard reference for the six-minute-walk test in healthy children aged 7 to 16 years," Am J Respir Crit Care Med. 176(2):174-80 (2007).
Park et al., "Ex vivo assessment of contractility, fatigability and alternans in isolated skeletal muscles," J Vis Exp. 69:e4198 (2012) (8 pages).
Phillips et al., "Improved activities of daily living and physical function, with decreased pain, in children with hypophosphatasia treated for three years with asfotase alfa: results from the childhood health assessment questionnaire and the pediatric outcomes data collection instrument," The Endocrine Society's 97th Annual Meeting & Expo, Mar. 5-8, San Diego, California. Poster Abstract FRI-224 (2015) (1 page).
Whyte et al., "Hypophosphatasia: Enzyme replacement therapy (asfotase alfa) decreases TNSALP substrate accumulation and improves functional outcomes in affected adolescents and adults," Bull Group Int Rech Sci Stomatol Odontol. 51(1):35 (2012) (1 page).
Sugano et al., "Successful gene therapy in utero for lethal murine hypophosphatasia," Hum Gene Ther. 23(4):399-406 (2012).

International Search Report and Written Opinion for International Patent Application No. PCT/US2015/039973, mailed Oct. 5, 2015 (12 pages).
Johnson et al., "Motor proficiency in children with neurofibromatosis type 1," Pediatr Phys Ther. 22(4):344-8 (2010).
Gates et al., "Effects of age, sex, and comorbidities on the pediatric outcomes data collection instrument (PODCI) in the general population," J Pediatr Orthop. 35(2):203-9 (2015).
International Search Report and Written Opinion for International Patent Application No. PCT/US2016/049983, mailed Nov. 29, 2016 (12 pages).
International Search Report and Written Opinion for International Patent Application No. PCT/US2016/015366, mailed Aug. 9, 2016 (14 pages).
Extended European Search Report for European Application No. 18173111.8, dated Aug. 21, 2018 (9 pages).
National Institute for Health and Care Excellence, "Highly Specialised Technology Evaluation: Asfotase alfa for treating paediatric-onset hypophosphatasia [ID 758]," Oct. 21, 2015, <www.nice.org.uk/guidance/hst6/documents/committee-papers-8> (99 pages).
Tomazos et al., "Determination of the Minimal Clinically Important Difference in the Six-Minute Walk Test for Patients with Hypophosphatasia," 55th Annual European Society for Paediatric Endocrinology Meeting, Sep. 10-12, Paris, France. 86, Abstract FC2.5, <abstracts.eurospe.org/hrp/0086/hrp0086FC2.5.htm> (2016) (4 pages).
International Search Report and Written Opinion for International Application No. PCT/US18/26868, mailed Sep. 7, 2018 (30 pages).
International Preliminary Report on Patentability for International Patent Application No. PCT/US2016/049983, issued Sep. 11, 2018 (9 pages).
"Sequence 4," SCORE Search Results for U.S. Appl. No. 12/599,679, retrieved Nov. 17, 2018 (2 pages).
Agochukwu et al., "Hearing loss in syndromic craniosynostoses: Introduction and consideration of mechanisms," available in PMC Aug. 13, 2014, published in final edited form as: Am J Audiol. 23(2):135-41 (2014) (13 pages).
Balasubramaniam et al., "Perinatal hypophosphatasia presenting as neonatal epileptic encephalopathy with abnormal neurotransmitter metabolism secondary to reduced co-factor pyridoxal-5'-phosphate availability," J Inherit Metab Dis. 33(Suppl 3):S25-33 (2010).
Barcia et al., "Infantile hypophosphatasia: treatment options to control hypercalcemia, hypercalciuria, and chronic bone demineralization," J Pediatr. 130(5):825-8 (1997).
Barvencik et al., "Skeletal mineralization defects in adult hypophosphatasia—a clinical and histological analysis," Osteoporosis Int. 22(10):2667-75 (2011).
Baumgartner-Sigl et al., "Pyridoxine-responsive seizures as the first symptom of infantile hypophosphatasia caused by two novel missense mutations (c.677T>C, p.M226T; c.1112C>T, p.T371l) of the tissue-nonspecific alkaline phosphatase gene," Bone. 40(6):1655-61 (2007).
Beck et al., "Whole-body MRI in the childhood form of hypophosphatasia," Rheumatol Int. 31(10):1315-20 (2011).
Beederman et al., "Molecular basis of cranial suture biology and disease: osteoblastic and osteoclastic perspectives," Genes Dis. 1(1):120-5 (2014).
Boulet et al., "A population-based study of craniosynostosis in metropolitan Atlanta, 1989-2003," Am J Med Genet A. 146A(8):984-91 (2008).
Chan et al., "Endoscope-assisted versus open repair of craniosynostosis: a comparison of perioperative cost and risk," J Craniofac Surg. 24(1):170-4 (2013).
Choi et al., "Craniosynostosis in growing children: pathophysiological changes and neurosurgical problems," J Korean Neurosurg Soc. 59(3):197-203 (2016).
Chong et al., "Minimally invasive suturectomy and postoperative helmet therapy: advantages and limitations," J Korean Neurosurg Soc. 59(3):227-32 (2016).
Clarke, "Normal bone anatomy and physiology," Clin J Am Soc Nephrol. 3(Suppl 3):S131-9 (2008).

(56) References Cited

OTHER PUBLICATIONS

Colantonio et al., "Closing the gaps in pediatric laboratory reference intervals: a CALIPER database of 40 biochemical markers in a healthy and multiethnic population of children," Clin Chem. 58(5):854-68 (2012).
Collmann et al., "Neurosurgical aspects of childhood hypophosphatasia," Childs Nerv Syst. 25(2):217-23 (2009).
Czerwinski et al., "Major morbidity and mortality rates in craniofacial surgery: an analysis of 8101 major procedures," Plast Reconstr Surg. 126(1):181-6 (2010).
Eade et al., "Pyrophosphate arthropathy in hypophosphatasia," Ann Rheum Dis. 40(2):164-70 (1981).
Esparza et al., "Complications in the surgical treatment of craniosynostosis and craniofacial syndromes: apropos of 306 transcranial procedures," Childs Nerv Syst. 24(12):1421-30 (2008).
Esparza et al., "Surgical treatment of isolated and syndromic craniosynostosis. Results and complications in 283 consecutive cases," Neurocirugía. 19(6):509-29 (2008).
Fraser, "Hypophosphatasia," Am J Med. 22(5):730-46 (1957).
Garber et al., "Comparing outcomes and cost of 3 surgical treatments for sagittal synostosis: a retrospective study including procedure-related cost analysis," Neurosurgery. 81(4):680-7 (2017).
Ginelliová et al., "Sudden death associated with syndromic craniosynostosis," Forensic Sci Med Pathol. 12(4):506-9 (2016).
Greenwood et al., "Familial incidence and associated symptoms in a population of individuals with nonsyndromic craniosynostosis," Genet Med. 16(4):302-10 (2014).
Guañabens et al., "Calcific periarthritis as the only clinical manifestation of hypophosphatasia in middle-aged sisters," J Bone Miner Res. 29(4):929-34 (2014).
Herring, "Mechanical influences on suture development and patency," Front Oral Biol. 12:41-56 (2008).
Hollis et al., "Current concepts in hypophosphatasia: case report and literature review," Int J Paediatr Dent. 23(3):153-9 (2013).
Hwang et al., "Update of diagnostic evaluation of craniosynostosis with a focus on pediatric systematic evaluation and genetic studies," J Korean Neurosurg Soc. 59(3):214-8 (2016).
Johnson et al., "Craniosynostosis," Eur J Hum Genet. 19(4):369-76 (2011).
Kabbani et al., "Craniosynostosis," Am Fam Physician. 69(12):2863-70 (2004).
Katsianou et al., "Signaling mechanisms implicated in cranial sutures pathophysiology: Craniosynostosis," BBA Clin. 6:165-76 (2016).
Khanna et al., "Pictorial essay: the many faces of craniosynostosis," Indian J Radiol Imaging. 21(1):49-56 (2011).
Kim et al., "Craniosynostosis: Updates in radiologic diagnosis," J Korean Neurosurg Soc. 59(3):219-26 (2016).
Kozlowski et al., "Hypophosphatasia. Review of 24 Cases," Pediatr Radiol. 5(2):103-17 (1976) (15 pages).
Krakow et al., "Clinical and radiographic delineation of bent bone dysplasia-FGFR2 type or bent bone dysplasia with distinctive clavicles and angel-shaped phalanges," Am J Med Genet A. 170(10):2652-61 (2016).
Mathijssen, "Guideline for care of patients with the diagnoses of craniosynostosis: working group on craniosynostosis," J Craniofac Surg. 26(6):1735-807 (2015).
Merrill et al., "Bent bone dysplasia-FGFR2 type, a distinct skeletal disorder, has deficient canonical FGF signaling," Am J Hum Genet. 90(3):550-7 (2012).
Millan, "The role of phosphatases in the initiation of skeletal mineralization," Calcif Tissue Int. 93(4):299-306 (2013).
Miller et al., "Ultrasound diagnosis of craniosynostosis," Cleft Palate Craniofac J. 39(1):73-80 (2002).
Millichap, "Cognitive Development of Children with Craniosynostosis," Pediatr Neurol Briefs. 29(6):47 (2015).
Mohn et al., "Hypophosphatasia in a child with widened anterior fontanelle: lessons learned from late diagnosis and incorrect treatment," Acta Paediatr. 100(7):e43-6 (2011).

Mornet et al., "A molecular-based estimation of the prevalence of hypophosphatasia in the European population," Ann Hum Genet. 75(3):439-45 (2011).
Nakamura-Utsunomiya et al., "Clinical characteristics of perinatal lethal hypophosphatasia: a report of 6 cases," Clin Pediatr Endocrinol. 19(1):7-13 (2010).
Oginni et al., "Radiological and biochemical resolution of nutritional rickets with calcium," Arch Dis Child. 88(9):812-17 (2003).
Opperman, "Cranial sutures as intramembranous bone growth sites," Dev Dyn. 219(4):472-85 (2000).
Reginato et al., "Musculoskeletal manifestations of osteomalacia and rickets," Best Pract Res Clin Rheumatol. 17(6):1063-80 (2003).
Rodgers et al., "Spring-assisted cranioplasty for the correction of non-syndromic scaphocephaly: a quantitative analysis of 100 consecutive cases," Plast Reconstr Surg. 140(1):125-34 (2017).
Rottgers et al., "Outcomes of endoscopic suturectomy with postoperative helmet therapy in bilateral coronal craniosynostosis," J Neurosurg Pediatr. 18(3):281-6 (2016).
Rozovsky et al., "Cranial ultrasound as a first-line imaging examination for craniosynostosis," Pediatrics. 137(2):e20152230 (2016) (9 pages).
Sabbagh et al., "Hypophosphatemia leads to rickets by impairing caspase-mediated apoptosis of hypertrophic chondrocytes," Proc Natl Acad Sci U S A. 102(27):9637-42 (2005).
Sakamoto et al., "Physiological changes and clinical implications of syndromic craniosynostosis," J Korean Neurosurg Soc. 59(3):204-13 (2016).
Salva et al., "Signaling networks in joint development," Dev Dyn. 246(4):262-74 (2017).
Seshia et al., "Myopathy with hypophosphatasia," Arch Dis Child. 65(1):130-1 (1990).
Shah et al., "Sudden infant death in a patient with FGFR3 P250R mutation," Am J Med Genet A. 140A(24):2794-6 (2006).
Sharma et al., "Bilateral femoral neck fractures in a young patient suffering from hypophosphatasia, due to a first time epileptic seizure," J Orthop Case Rep. 5(3):66-8 (2015).
Sharma, "Craniosynostosis," Indian J Plast Surg. 46(1):18-27 (2013).
Silver et al., "Pulmonary hypoplasia in neonatal hypophosphatasia," Pediatr Pathol. 8(5):483-93 (1988) (12 pages).
Thacher et al., "Radiographic scoring method for the assessment of the severity of nutritional rickets," J Trop Pediatr. 46(3):132-9 (2000).
Thurner et al., "Osteopontin deficiency increases bone fragility but preserves bone mass," Bone. 46(6):1564-73 (2010).
Tokumaru et al., "Skull base and calvarial deformities: association with intracranial changes in craniofacial syndromes," Am J Neuroradiol. 17(4):619-30 (1996).
Watanabe et al., "Prevalence of c. 1559delT in ALPL, a common mutation resulting in the perinatal (lethal) form of hypophosphatasia in Japanese and effects of the mutation on heterozygous carriers," J Hum Genet. 56(2):166-8 (2011).
Whyte et al., "Adult hypophosphatasia with chondrocalcinosis and arthropathy: variable penetrance of hypophosphatasemia in a large Oklahoma kindred," Am J Med. 72(4):631-41 (1982).
Whyte et al., "Adult hypophosphatasia treated with teriparatide," J Clin Endocrinol Metab. 92(4):1203-8 (2007).
Whyte et al., "Rickets and osteomalacia," Medicine. 37(9):483-8 (2009).
Zaleckas et al., "Diagnosis and treatment of craniosynostosis: Vilnius team experience," Acta Med Litu. 22(2):111-21 (2015).
Anderson, "Mechanism of Mineral Formation in Bone," *Pathology Reviews*. Emanuel Rubin and Ivan Damjanov (eds.), 13-23 (1990).
Whyte, Chapter 73: Hypophosphatasia: Nature's Window on Alkaline Phosphatase Function in Humans, *Principles of Bone Biology*, vol. 1, Third Edition. John P. Bilezikian, Lawrence G. Raisz and T. John Martin (eds.), 1573-98 (2008).
Whyte, Chapter 22: Hypophosphatasia, *Genetics of Bone Biology and Skeletal Disease*. Rajesh V. Thakker, Michael P. Whyte, John A. Eisman and Takashi Igarashi (eds.), 337-360 (2013).
Del Angel et al., "Birth prevalence estimation of severe Hypophosphatasia in European populations using large-scale protein-coding genetic variation databases," American Society of Human

(56) References Cited

OTHER PUBLICATIONS

Genetics 66th Annual Meeting, Oct. 18-22, Vancouver, Canada. Poster abstract 1670T (2016) (2 pages).
Rockman-Greenberg et al., "Hypophosphatasia: Enzyme Replacement with ENB-0040, a Bone-Targeted Human Recombinant Tissue Nonspecific Alkaline Phosphatase (TNSALP) Fusion Protein," American College of Medical Genetics, 16th Annual Clinical Genetics Meeting, Mar. 25-29, Tampa, Florida (2009) (1 page).
Simmons, "Best Practices In: Recognizing and Diagnosing Hypophosphatasia," Clinical Endocrinology News. <www.mdedge.com/sites/default/files/issues/articles/Alexion_10_11_Final_Web.pdf>, published Sep. 30, 2013, retrieved on Mar. 27, 2019 (8 pages).
Weber et al., "Burden of disease in children with hypophosphatasia: results from patient-reported surveys," 7th International Conference on Children's Bone Health, Jun. 27-30, Salzburg, Austria. Bone Abstracts. 4: P119 (2015) (3 pages).
Whyte et al., "Asfotase alfa: Sustained Efficacy and Tolerability in Infants and Young Children with Life-Threatening Hypophosphatasia," 2014 Pediatric Academic Societies and Asian Society for Pediatric Research Joint Meeting, May 3-6, Vancouver, BC, Canada. Poster 69 (2014) (1 page).
Whyte et al., "Hypophosphatasia: A Retrospective Natural History Study of the Severe Perinatal and Infantile Forms," 2014 European Calcified Tissue Society Congress, May 17-20, Prague, Czech Republic. Poster P364 (2014) (1 page).
Whyte et al., "A retrospective, multi-national, non-interventional, natural history study of the childhood form of hypophosphatasia," ENDO 2015: The Endocrine Society Annual Meeting, Mar. 5-8, San Diego, California. Abstract LB-OR01-4 (2015) (2 pages).
Stoll et al., "Severe hypophosphatasia due to mutations in the tissue-nonspecific alkaline phosphatase (TNSALP) gene," Genet Couns. 13(3):289-95 (2002).
Mornet, "Hypophosphatasia," Best Pract Res Clin Rheumatol. 22(1):113-27 (2008).
Kajdic et al., "Craniosynostosis—Recognition, clinical characteristics, and treatment," Bosn J Basic Med Sci. 18(2):110-6 (2018).
Dortschy et al., "Bevölkerungsbezogene verteilungswerte ausgewählter laborparameter aus der studie zur gesundheit von kindern und jugendlichen in Deutschland (KiGGS)," Gesundheitsberichterstattung des Bundes, Robert Koch Institute (2009) (136 pages).
Communication pursuant to Rule 164(2)(b) and Article 94(3) EPC for European Patent Application No. 16707571.2, dated Feb. 26, 2019 (12 pages).
Fong et al., "Hypocalcemia: Updates in diagnosis and management for primary care," Can Fam Physician. 58(2):158-62 (2012).
Makras et al., "Medical treatment of Hypercalcaemia," Hormones. 8(2):83-95 (2009).
Extended European Search Report for European Application No. 15907550.6, dated Jun. 4, 2019 (7 pages).
Kosnik-Infinger et al., "Enzyme replacement therapy for congenital hypophosphatasia allows for surgical treatment of related complex craniosynostosis: a case series," Neurosurg Focus. 38(5):E10 (2015) (6 pages).
Official Action for Russian Patent Application No. 2017123540, dated Jul. 8, 2019 (15 pages).
Di Rocco et al. "Craniosynostosis and hypophosphatasia," Arch Pediatr. 24(5S2):5S89-5S92 (2017).
Official Action and Translation for Japanese Application No. 2017-539393, mailed Sep. 17, 2019 (14 pages).
Whyte et al. "Natural history of perinatal and infantile hypophosphatasia: a retrospective study," J Pediatr. 209:116-124.e4 (2019) (13 pages).
Leung et al. "Outcome of perinatal hypophosphatasia in Manitoba Mennonites: a retrospective cohort analysis," JIMD Rep. 11:73-78 (2013).
Taketani et al. Chapter 9: Hypophosphatasia. *Human Pathobiochemistry*. T. Oohashi et al. (eds.), 91-100 (2019).
Morrison et al. "Mitigation of tracheobronchomalacia with 3D-printed personalized medical devices in pediatric patients," available in PMC Apr. 29, 2016, published in final edited form as: Sci Transl Med. 7(285):285ra264 (2015) (23 pages).
Whyte et al. "Asfotase alfa for infants and young children with hypophosphatasia: 7 year outcomes of a single-arm, open-label, phase 2 extension trial," Lancet Diabetes Endocrinol. 7(2):93-105 (2019) (52 pages).
Mornet, "The tissue nonspecific alkaline phosphatase gene mutations database," <www.sesep.uvsq.fr/03_hypo_mutations.php>, last updated Nov. 28, 2019 (14 pages).
Hancarova et al. "Hypophosphatasia due to uniparental disomy," Bone. 81:765-766 (2015).
Carden et al. "Tracheomalacia and tracheobronchomalacia in children and adults: an in-depth review," Chest. 127(3):984-1005 (2005).
Murgu et al. "Tracheobronchomalacia and excessive dynamic airway collapse," Respirology. 11(4):388-406 (2006).
Whyte et al., "Hypophosphatasia (HPP) in children: enzyme replacement therapy (EzRT) using bone-targeted, tissue-nonspecific alkaline phosphatase (TNSALP)," Ann Neurol. 68(Suppl 14):S70 Abstract WIP-28 (2010) (1 page).
Park et al. "The effect of alendronate loaded biphasic calcium phosphate scaffolds on bone regeneration in a rat tibial defect model," Int J Mol Sci. 16(11):26738-53 (2015) (17 pages).
Li et al. "Timing of the initiation of bisphosphonates after surgery for fracture healing: a systematic review and meta-analysis of randomized controlled trials," Osteoporos Int. 26(2):431-41 (2015) (11 pages).
International Search Report and Written Opinion for International Application No. PCT/US2019/045963, mailed Jan. 30, 2020 (26 pages).
Rodionova et al., "Hypophosphatasia in adults: clinical cases and literature review," Osteoporosis and Bone Diseases. 18(2):25-7 (2015) (4 pages).
Search Report and Translation for Russian Application No. 2018109368, dated Feb. 5, 2020 (4 pages).
Wang et al. "The effects of tissue-non-specific alkaline phosphatase gene therapy on craniosynostosis and craniofacial morphology in the $FGFR2^{C342Y/+}$ mouse model of Crouzon craniosynostosis," Orthod Craniofac Res. 18 Suppl. 1(01):196-206 (2015).
Abrams et al., "Calcium and Vitamin D Requirements of Enterally Fed Preterm Infants," Pediatrics. 131(5): e1676-e1683 (2013) (9 pages).
Kishnani et al., "Hypophosphatasia: enzyme replacement therapy (ENB-0040) decreases TNSALP substrate accumulation and improves functional outcome in affected adolescents and adults," Endocrine Society's 15th International & 14th European Congress of Endocrinology, May 5-9, Florence, Italy. Abstract OC8.1 (2012) (4 pages).
Office Action for Japanese Application No. 2018-508754, mailed Jul. 1, 2020 (4 pages).
"Printing ENDO 2015: Hypophosphatasia in the Spotlight," http://www.raredr.com/print.php, retrieved Jan. 27, 2017.
Office Action for European Patent Application No. 16739617.5, dated May 11, 2020 (10 pages).
Office Action for Russian Patent Application No. 2018137822, mailed Jul. 24, 2020 (20 pages).
Bishop et al., "Life-threatening hypophosphatasia (HPP): Results of up to two years bone-targeted Enzyme Replacement Therapy (ERT) in infants and young children," Bone. 48:S82 (2011).
Little et al., "Lineage tracking of myogenic progenitors in surgical models of tibial bone repair," Bone. 48(2):S82 (2011).
Whyte et al., "Treatment of children with hypophosphatasia (HPP) with ENB-0040: radiographic and DXA outcomes after 6 months of therapy," Horm Res Paediatr. 76(Suppl 2):26 (2011).
Kim et al., "Comparison of phenylketonuria (PKU) patients' height, weight and body mass index (BMI) to the general population," Molecular Genetics and Metabolism. 105:328-329 (2012).
Office Action for Japanese Patent Application No. 2018-515934, mailed Jul. 28, 2020 (7 pages).
Sequencia—"Bone targeted alkaline phosphatase," UniParc, (20101102), Database No. HI520929 (1 page).
Seefried et al., "Long-term Effectiveness of Asfotase Alfa Treatment in Adults with Pediatric-onset Hypophosphatasia in Routine Clinical Practice" 2020 American Society for Bone and Mineral Research Virtual Conference, Sep. 11-15, 2020.

(56) References Cited

OTHER PUBLICATIONS

Seefried et al., "Real-world Clinical Profiles of Adults with Hypophosphatasia (HPP) from the Global HPP Registry," The American Society for Bone and Mineral Research 2020 Annual Meeting, Sep. 11-15, virtually (2020).
Seefried et al., "Bone Turnover and Mineral Metabolism in Adult Patients with Pediatric-Onset Hypophosphatasia Treated With Asfotase Alfa," The American Society for Bone and Mineral Research 2020 Annual Meeting, Sep. 11-15, virtually (2020).
Seefried et al., "Long-term Effectiveness of Asfotase Alfa Treatment in Adults with Pediatric-onset Hypophosphatasia in Routine Clinical Practice" 22nd European Congress of Endocrinology, Sep. 5-9, virtual (2020).
Seefried et al., "Long-term Effectiveness of Asfotase Alfa Treatment in Adults with Pediatric-onset Hypophosphatasia in Routine Clinical Practice" 2020 World Congress of Osteoporosis, Osteoarthritis, and Muscoskeletal Diseases, Aug. 20-23, Barcelona, Spain (2020).
Anonymous: "Scale-up of CHO fed-batch cultures in HyClone (TM) ActiPro (TM) medium supplemented with Cell Boost (TM) 7a and 7b," Oct. 11, 2016, pp. 1-4, XP055461185.
Notice of Reasons for Rejection for Japanese Patent Application No. 2019-553247, mailed Apr. 20, 2022 (5 pages).
International Search Report and Written Opinion of the International Searching Authority for International Application No. PCT/US2020/064140, mailed Apr. 23, 2021 (12 pages).
GenBank NM_000478.2, "*Homo sapiens* alkaline phosphatase, liver/bone/kidney (ALPL), mRNA," <https://www.ncbi.nlm.nih.gov/nuccore/NM_000478.2>, dated Sep. 17, 2006, retrieved on Feb. 23, 2021 (7 pages).
International Search Report and Written Opinion for International Patent Application No. PCT/US2022/016031, mailed May 3, 2022 (9 pages).
Office Action for Canadian Patent Application No. 2,993,358, dated Sep. 20, 2022 (6 pages).
Luo et al., "Lower ultrafiltration temperature improves membrane performance and emulsifying properties of milk protein concentrates," Dairy Sci. & Technol. 95(1):15-31 (Sep. 2014).
Miller et al., "Genetic diversity and population structure of the endangered marsupial *Sarcophilus harrisii* (Tasmanian devil)," Proc Natl Acad Sci U S A. 108(30):12348-53 (Jul. 2011).
Partial Supplementary European Search Report for European Application No. 20898477.3, dated Dec. 6, 2023 (25 pages).
UniProtKB Accession No. G3WYY8. Retrieved Nov. 16, 2011 (4 pages).
Official Action for Japanese Application No. 2021-506690, dated Nov. 7, 2023 (10 pages).
International Search Report and Written Opinion for International Patent Application No. PCT/US2021/055991, mailed Jan. 25, 2022 (8 pages).
Official Action for Eurasian Application No. 202391228, dated Dec. 13, 2023 (5 pages).
Oguchi et al., "Control of Temperature and pH Enhances Human Monoclonal Antibody Production in CHO Cell Culture," Animal Cell Technology: Basic and Applied Aspects. Springer/Dordrecht. 13:169-172 (Jan. 2003).
Koumpouras et al., "Dynamic Optimization of Bioprocesses," Applied Mathematics. 3(10A):1487-1495 (Oct. 2012).
"Common Drug Review: Pharmacoeconomic Review Report for asfotase alfa (Strensiq)," Canadian Agency for Drugs and Technologies in Health (Apr. 2017) (25 pages).
Office Action for Eurasian Application No. 202390771/28, dated Jan. 16, 2024 (3 pages).
Examination Report for Australian Application No. 2021337652, dated Feb. 28, 2024 (5 pages).
Sutton et al., "Atypical femoral fractures' during bisphosphonate exposure in adult hypophosphatasia" J Bone Miner Res. 27(5):987-94 (May 2012).
Office Action for Canadian Patent Application No. 3,173,631, dated Jan. 26, 2024 (5 pages).
"Alkaline phosphatase, tissue-nonspecific isozyme [Galeopterus variegatus]," GenBank, accession No. XP_008584004, accessed Jul. 22, 2014, (2 pages).
"Alkaline phosphatase, tissue-nonspecific isozyme isoform X3 [Erinaceus europaeus]," GenBank, accession No. XP_016048561, accessed Apr. 11, 2016, (2 pages).
Office Action for Canadian Patent Application No. 3,161,266, dated Feb. 14, 2024 (4 pages).
International Search Report and Written Opinion for International Patent Application No. PCT/US2021/048792, mailed Dec. 23, 2021 (11 pages).
"STIC search of SEQ ID No. 1," U.S. Appl. No. 13/899,359, filed May 21, 2013, dated Feb. 22, 2024 (2 pages).
Seffernick et al., "Melamine deaminase and atrazine chlorohydrolase: 98 percent identical but functionally different," J Bacteriol. 183(8):2405-10 (2001).
Broun et al., "Catalytic plasticity of fatty acid modification enzymes underlying chemical diversity of plant lipids," Science 282(5392):1315-7 (1998) (4 pages).
Dirks, "Brain tumor stem cells: Bringing order to the chaos of brain cancer," J Clin Oncology 26(17):2916-2924 (2008).
López-Lázaro, "The migration ability of stem cells can explain the existence of cancer of unknown primary site. Rethinking metastasis," Oncoscience. 2(5):467-75 (2015).
Tran et al., "Survival comparison between glioblastoma multiforme and other incurable cancers," J Clin Neurosci. 17(4):417-421 (2010).
Mabey, "Epidemiology of sexually transmitted infections: worldwide," Medicine 42(6):287-290 (2014).
"Alkaline phosphotase (EC=3.1.3.1) from *Kryptolebias marmoratus* (Mangrove killifish) (Rivulus marmoratus)," XP093139356, retrieved from EBI accession No. UNIPROTKB:A0A3Q3B3R2_KRYMA, accessed Jul. 31, 2019 (2 pages).
"Alkaline phosphatase, tissue-nonspecific isozyme isoform X4 from *Denticeps clupeoides* (denticle herring)," XP093139383, retrieved from EBI accession No. NCBI:XP_028853958, accessed Apr. 24, 2019 (2 pages).
Extended European Search Report for European Patent Application No. 20898477.3, dated Mar. 28, 2024 (30 pages).
Ishida et al., "Structure and Function of Aklaline Phosphatases," Japanese Journal of Clinical Chemistry. 33:36-44 (2004).
GE Healthcare, "Cell BoostTM 7a and 7b supplements," first published Sep. 2015 (4 pages).
Genest et al., "Physical Function and Health-Related Quality of Life in Adults Treated with Asfotase Alfa for Pediatric-Onset Hypophosphatasia," JBMR Plus. 4(9):e10395 (Sep. 2020) (9 pages).
Genest et al., "Long-term effectiveness of Asfotase Alfa in adults with pediatric-onset Hypophosphatasia in routine clinical practice," Journal of Bone and Mineral Research. 35(Supplement_1) from ASBMR 2020 Annual Meeting (Nov. 2020) (1 page).
Uki et al., "A brief cancer pain assessment tool in Japanese: the utility of the Japanese Brief Pain Inventory—BPI-J," J Pain Symptom Manage. 16(6):364-73 (Dec. 1998).
Christou et al., "Rational design of murine secreted alkaline phosphatase for enhanced performance as a reporter gene in mouse gene therapy preclinical studies," Hum Gene Ther. 22(4) (Apr. 2011) (Abstract).

\* cited by examiner

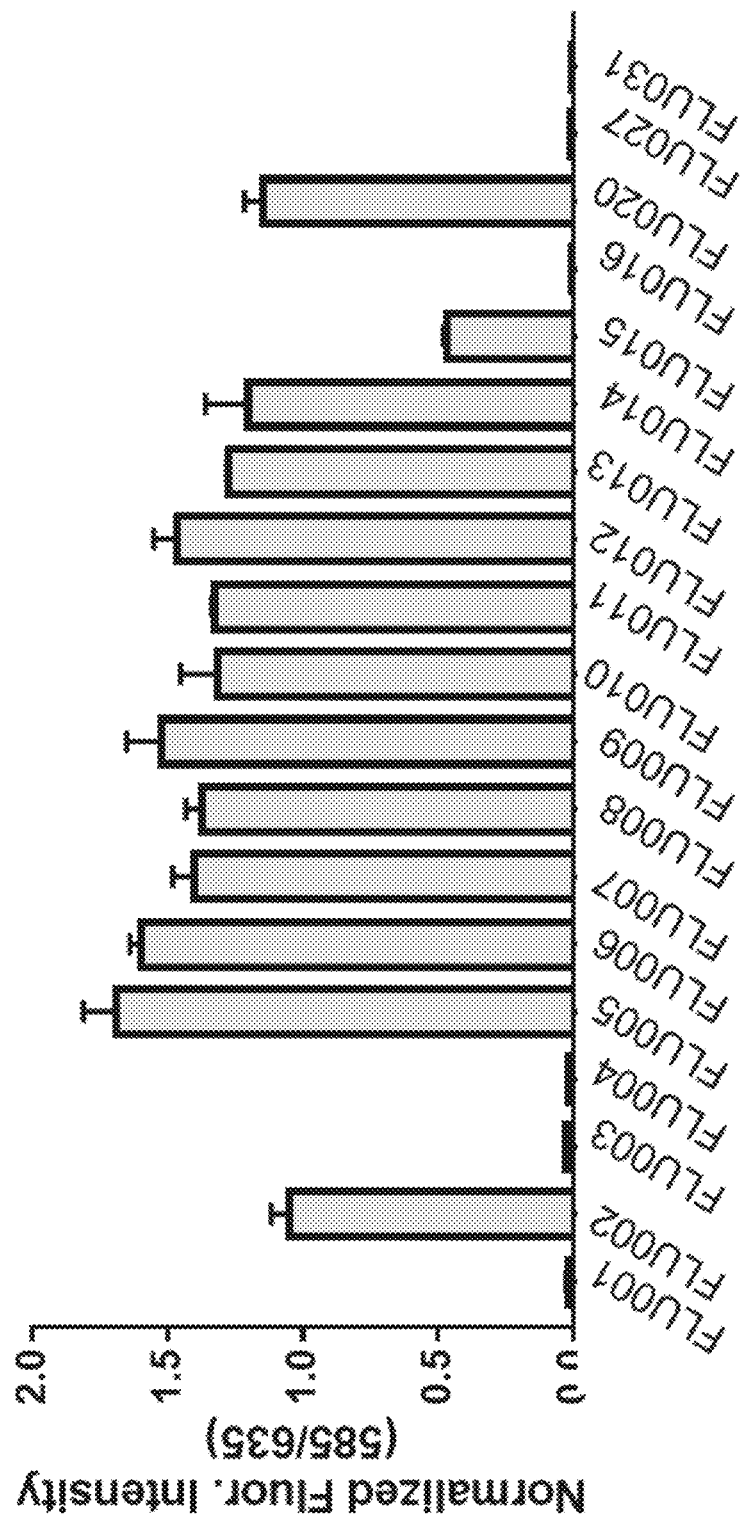

ALKALINE PHOSPHATASE POLYPEPTIDES AND METHODS OF USE THEREOF

BACKGROUND

Hypophosphatasia (HPP) is a rare, heritable skeletal disease with an incidence of 1 per 100,000 births for the most severe forms of the disease. The disorder typically results from loss-of-function mutations in the gene coding for tissue-nonspecific alkaline phosphatase (TNSALP). HPP exhibits a remarkable range of symptoms and severity, from premature tooth loss to almost complete absence of bone mineralization in utero. The presentation of HPP varies markedly among patients and also varies markedly between patient ages. Many patients with HPP display skeletal changes, short stature, chronic pain, painful lower limbs, muscle weakness, gait disturbance, and premature, atraumatic tooth loss.

Asfotase alfa (STRENSIQ®, Alexion Pharmaceuticals, Inc.), a recombinantly produced enzyme replacement therapy (ERT) that includes a soluble fragment of TNSALP, is the first ERT available to HPP patients. Asfotase alfa has shown transformative effects on the most severe form of HPP as evidenced by improvements in bone mineralization and density, as well as respiratory and motor function, cognitive development, and muscle strength (Whyte et al., *New Engl. J. Med.* 366:904-913, 2012). While the safety and therapeutic benefits of asfotase alfa have been demonstrated, compliance with multiple injection regimens can be a challenge, particularly among pediatric patients. The most common side effects from the three to six times weekly subcutaneous administration are injection site reactions (i.e., pruritus, pain, and erythema). Therefore, improvements would be desirable to improve quality of life, for example, by decreasing dosing volume and frequency and increase compliance. Accordingly, new compositions and methods for treating HPP and related bone mineralization disorders would be beneficial.

SUMMARY OF THE DISCLOSURE

In one aspect, featured is a polypeptide including a recombinant alkaline phosphatase having at least one mutation relative to a naturally occurring alkaline phosphatase. The mutation may improve at least one activity or pharmacokinetic (PK) property relative to the naturally occurring alkaline phosphatase without the at least one mutation.

The naturally occurring alkaline phosphatase may be a tissue non-specific alkaline phosphatase (TNSALP), placental alkaline phosphatase (PALP), germ line alkaline phosphatase (GALP), or intestinal alkaline phosphatase (IALP). The TNSALP may be a mammalian TNSALP (e.g., human, gorilla, mouse, rabbit, chimp, cynomolgus macaque, rhesus macaque, orangutan, baboon, rat, bovine, goat, or llama TNSALP). The polypeptide may have at least 85% (e.g., 90%, 95%, 97%, 99%, or 100%) sequence identity to amino acids 1-491 of SEQ ID NO: 1.

At least one mutation may be selected from the group consisting of E108X, M384X, L385X, N213X, and N286X relative to SEQ ID NO: 1, and X is any amino acid. The at least one mutation may be selected from the group consisting of E108S, E108T, E108Q, E108M, E108K, E108L, M384R, L385T, N213Q, and N286Q relative to SEQ ID NO: 1. The recombinant alkaline phosphatase may have at least two, three, four, or five mutations selected from the group consisting of E108S, E108T, E108Q, E108M, E108K, E108L, M384R, L385T, N213Q, and N286Q relative to SEQ ID NO: 1. For example, the recombinant alkaline phosphatase may have E108M, N213Q, and N286Q mutations relative to SEQ ID NO: 1. The recombinant alkaline phosphatase may not have an E108A mutation relative to SEQ ID NO: 1.

The at least one mutation in the ALPs described herein that improves at least one activity or pharmacokinetic (PK) property may be present within a specified region of the enzyme. The mutation may be present in the ectodomain of an alkaline phosphatase. For example, the mutation may be present in the crown domain, the catalytic domain, or the dimerization domain. The mutation may be present in the GPI anchor domain, if included. The polypeptide may include a mutation that is present within amino acids 1-491 or 1-486 of a human TNSALP or an analogous ALP position based on alignment and/or sequence homology. For example, the polypeptide may have a mutation within positions 1-491, 1-486, 25-475, 25-240, 50-400, 50-350, and/or 100-300 relative to SEQ ID NO: 1. The polypeptide may have a mutation within positions 100-125, 100-110, 200-225, 210-220, 275-300, 280-290, 425-450, and/or 425-435 relative to SEQ ID NO: 1. For example, the polypeptide may have a mutation between positions 108, 213, 286, and/or 429 relative to SEQ ID NO: 1. In certain embodiments, the mutation is within the sequence of the ALP and the mutation is not a stretch of non-natural amino acids present at the N- or C-terminal domain of the ALP.

The naturally occurring alkaline phosphatase may be an IALP (e.g., a mammalian IALP, such as gorilla, chimp, cynomolgus macaque, rhesus macaque, rat, bovine, goat, llama, or human IALP). The polypeptide may have at least 85% (e.g., 90%, 95%, 97%, 99%, or 100%) sequence identity to amino acids 1-486 of SEQ ID NO: 4. The recombinant alkaline phosphatase may have a W245X mutation relative to SEQ ID NO: 4, where X is any naturally occurring conserved amino acid from a different species. The recombinant alkaline phosphatase may have a W245R mutation relative to SEQ ID NO: 4. The recombinant alkaline phosphatase may have a C481X mutation relative to SEQ ID NO: 4, where X is any non-thiol containing amino acid. The recombinant alkaline phosphatase may have a C481G mutation relative to SEQ ID NO: 4.

The recombinant alkaline phosphatase may have a mutation at a consensus N-linked glycosylation site. A consensus N-linked glycosylation site includes a motif having the sequence asparagine-X-Z, where X is any amino acid except P, and Z is any amino acid except S or T. The asparagine site may be mutated to a glutamine residue.

The recombinant alkaline phosphatase may have a mutation selected from the group consisting of S429Q, S429H, S429E, and S429D relative to SEQ ID NO: 4. The recombinant alkaline phosphatase may have a mutation selected from the group consisting of S428R, S428Q, and S428D relative to SEQ ID NO: 4.

The recombinant alkaline phosphatase may have at least 80%, 85%, 90%, 95%, 99%, or 100% sequence identity to at least 50 (e.g., at least 100, 150, 200, 250, 300, 350, 400, 450, or more) amino acids of the sequence of any one of SEQ ID NOs: 7-223, 247, and 262-264.

At least one activity improved by the mutation may be selected form the group consisting of increased catalytic activity, increased temperature stability, increased zinc binding, maintenance of activity in a zinc depleted buffer, maintenance of activity at a pH of 5.0-7.5, decreased dimerization, decreased aggregation, and increased manufacturability. The increased catalytic activity may include increased hydrolysis of pyridoxal 5-phosphate and/or pyrophosphate. The increased catalytic activity may be about 2-fold to about 30-fold better than the activity of the naturally occurring alkaline phosphatase. The at least one PK property improved by the mutation may be selected from the group consisting of increased substrate specificity, increased activity against a native substrate, increased activity against an artificial substrate, decreased Km for a native substrate, and increased area under the curve (AUC) per dose. Exemplary artificial substrates are 4-methylumbelliferyl phosphate (4-MUP), umbelliferone phosphate, and paranitrophenyl phosphate (pNPP), and exemplary native substrates are pyridoxal-5'-phosphate, PLP, and PEA.

In some embodiments, the polypeptide may further include a region Y, where Y is an amino acid sequence of at least one amino acid. Y may be a fragment crystallizable region (Fc). The Fc region may include IgG1, IgG2, IgG3, or IgG4, or a chimera thereof. For example, the Fc region may include an IgG2/4 chimera. The Fc region may include the sequence of SEQ ID NO: 253 or have at least 85% (e.g., 90%, 95%, 97%, 99%, or 100%) sequence identity thereto.

The polypeptide may further include a bone targeting moiety. A polypeptide including an ALP, a bone targeting moiety, and a Y region can have the structure Z-ALP-Y-Xn, where Y is an amino acid sequence of at least one amino acid; Z is absent or is an amino acid sequence of at least one amino acid; Xn is a bone-targeting moiety selected from the group consisting of poly aspartate (Dn), poly glutamate (En), poly (aspartate-alanine-aspartate) (DAD)n, poly (aspartate-aspartate-serine) (DDS)n, poly (aspartate-serine-serine (DSS)n, poly (glutamate-glutamate-serine) (EES)n, and VHH, and n=1 to 50; and ALP is the recombinant alkaline phosphatase.

The polypeptide may have the structure Y-ALP-Z-Xn, or any topological permutations thereof (e.g., Xn-Y-ALP-Z and Y-Xn-ALP-Z).

The polypeptide may include or consist of the an amino acid sequence having at least 85% (e.g., at least 90%, 95%, 97%, 99%, or 100%) sequence identity to any one of SEQ ID NOs: 7-223, 247, and 262-264 (e.g., any one of SEQ ID NOs: 72, 123, 155, or 177). For example, the polypeptide may include or consist of the sequence of any one of SEQ ID NOs: 72, 123, 155, or 177. The polypeptide may include any sALP catalytic domain, Fc IgG isotype, or bone targeting moiety listed in Table 1, and topological permutations thereof. The polypeptide may include or consist of an amino acid sequence having at least 85% (e.g., at least 90%, 95%, 97%, 99%, or 100%) sequence identity to SEQ ID NO: 123. The polypeptide may include or consist of SEQ ID NO: 123.

The polypeptide may include or consist of an amino acid sequence having at least 85% (e.g., at least 90%, 95%, 97%, 99%, or 100%) sequence identity to SEQ ID NO: 177. The polypeptide may include or consist of SEQ ID NO: 177.

The polypeptide may include or consist of an amino acid sequence having at least 85% (e.g., 90%, 95%, 97%, 99%, or 100%) sequence identity to SEQ ID NO: 260 or 261. The polypeptide may include or consist of the sequence of SEQ ID NO: 260. The polypeptide may include or consist of the sequence of SEQ ID NO: 261.

The polypeptide may include a secretion signal peptide. The polypeptide may include or consist of an amino acid sequence having at least 85% (e.g., 90%, 95%, 97%, 99%, or 100%) sequence identity to SEQ ID NO: 263 or 264. The polypeptide may include or consist of the sequence of SEQ ID NO: 263. The polypeptide may include or consist of the sequence of SEQ ID NO: 264.

In some embodiments, the polypeptide is a dimer. Alternatively, the polypeptide may be a monomer.

Also featured is a polypeptide including an alkaline phosphatase and a fragment crystallizable (Fc) region, wherein the Fc region is an IgG2/4 chimera. The Fc region may include the sequence of SEQ ID NO: 253 or have at least 85% (e.g., 90%, 95%, 97%, 99%, or 100%) sequence identity thereto. The recombinant alkaline phosphatase may be selected from the group consisting of TNSALP, IALP, placental alkaline phosphatase (PALP), and germ line alkaline phosphatase (GALP). The recombinant alkaline phosphatase may be a mammalian alkaline phosphatase (e.g., human, gorilla, mouse, rabbit, chimp, cynomolgus macaque, rhesus macaque, orangutan, baboon, rat, bovine, goat, or llama alkaline phosphatase). The recombinant alkaline phosphatase may include the sequence of any one of SEQ ID NOs: 1-6 or a fragment thereof. For example, the recombinant alkaline phosphatase may include amino acids 1-491 of SEQ ID NO: 1 or amino acids 1-486 of SEQ ID NO: 4.

In some embodiments of any of the above aspects, the polypeptide further includes a bone targeting moiety, Xn, selected from the group consisting of Dn, En, (DAD)n, (DDS)n, (DSS)n, (EES)n, and VHH, wherein n=1 to 50 (e.g., 1 to 30). In some particular embodiments, the bone targeting moiety may be Dn where n=7 to 10; En where n=10 to 15; (DAD)n where n=2 to 4; (DDS)n where n=2 to 4; (DSS)n where n=3; or (EES)n where n=3 to 4. For example, the bone targeting moiety may include (DAD)$_3$ or (DDS)$_3$.

The VHH bone targeting moiety may include one or more substitutions. For example, at least one (e.g., two or three) complementary determining region (CDR) of the VHH may be substituted with at least one (e.g., 2 to 30, e.g., 5 or 7) glutamate or aspartate residue.

In some embodiments, the polypeptides described herein are post-translationally modified (e.g., glycosylated or sialylated).

Also featured is a polynucleotide encoding the polypeptide of any of the above aspects, a vector containing the polynucleotide, and a cell (e.g., a mammalian cell, such as a CHO cell or an HEK293 cell) containing the polynucleotide or the vector. The polynucleotide may encode an amino acid sequence having at least 85% (e.g., 90%, 95%, 97%, 99%, or 100%) sequence identity to any one of SEQ ID NOs: 7-223, 247, and 262-264 (e.g., any one of SEQ ID NOs: 72, 123, 155, or 177). The polynucleotide may have at least 85% (e.g., 90%, 95%, 97%, 99%, or 100%) sequence identity to any one of SEQ ID NOs: 265-268. The polynucleotide may include or consist of any one of SEQ ID NOs: 265-268. The polynucleotide may include or consist of SEQ ID NO: 265. The polynucleotide may include or consist of SEQ ID NO: 266. The polynucleotide may include or consist of SEQ ID NO: 267. The polynucleotide may include or consist of SEQ ID NO: 268.

In some embodiments, the polypeptide is not or does not include the sequence of SEQ ID NO: 269.

In some embodiments, the alkaline phosphatase does not include the alkaline phosphatase of asfotase alfa (e.g., amino acids 1-485) of SEQ ID NO: 269.

In some embodiments, the polypeptide is not a polypeptide with the amino acid sequence of SEQ ID NO: 269 and does not include the alkaline phosphatase of asfotase alfa (e.g., amino acids 1-485) of SEQ ID NO: 269.

Also featured is a method of producing the polypeptide of any of the above aspects by providing a cell (e.g., a mammalian cell, such as a CHO cell or an HEK293 cell) transformed with the polynucleotide or vector encoding the polypeptide, such that the polynucleotide is positioned for expression in the cell; culturing the transformed cell under conditions suitable for expressing the polynucleotide, wherein the culturing results in expression of the polypeptide; and isolating the polypeptide.

Also featured is a pharmaceutical composition containing the polypeptide of any of the above aspects and a pharmaceutically acceptable carrier. The pharmaceutically acceptable carrier may include sodium chloride and/or sodium phosphate. The composition may include about 150 mM sodium chloride and/or about 25 mM sodium phosphate at a pH of about 7.4.

The composition may be formulated at a dosage of from about 0.1 mg/mL to about 10 mg/mL. The composition may be formulated in a volume of about 0.1 mL to about 50 mL (e.g., about 0.1 to about 10 mL).

In another aspect is featured a method of treating a disease selected from the group consisting of hypophosphatasia (HPP), bone fracture, osteoporosis, sclerosteosis, chondrocalcinosis, hypotonia, Duchenne's muscular dystrophy, tracheobronchomalacia, seizure, neurofibromatosis (e.g., NF-1), and craniosynostosis, or one or more symptoms thereof, in a subject (e.g., a human subject) in need thereof by administering to the subject the polypeptide or the pharmaceutical composition of any of the above aspects to the subject. The polypeptide may be administered in an amount and for a duration sufficient to treat the disease or to alleviate one or more symptoms thereof. The treating may enhance bone formation in the subject. The polypeptide may be used to treat muscle weakness.

The polypeptide may be administered at a dosage of from about 0.01 mg/kg to about 60 mg/kg (e.g., from about 0.1 mg/kg to about 50 mg/kg, e.g., from about 0.1 mg/kg to about 20 mg/kg, e.g., from about 0.1 mg/kg to about 10 mg/kg). The polypeptide may be administered once per day, week, month, or year (e.g., once per week). The polypeptide may be administered at a dosage of from about 0.01 mg/kg/week to about 20 mg/kg/week (e.g., from about 0.1 mg/kg/week to about 10 mg/kg/week). The polypeptide may be administered for at least one day, one week, one month, one year, or longer.

The polypeptide may be administered subcutaneously, intravenously, intramuscularly, sublingually, intrathecally, or intradermally. In particular, the polypeptide, or a composition containing the polypeptide, may be administered by subcutaneous administration.

The subject may be a human subject, such as a neonate, a child, an adolescent, or an adult.

Prior to administration of the recombinant polypeptide, the subject may be characterized as having an average walking distance in six minutes of about 350 meters or less. Administration of the recombinant polypeptide may promote an increase in an average walking distance in six minutes by the subject of at least 100 meters or more. The subject may exhibit an average walking distance in six minutes of about 500 meters or more after administration of the recombinant polypeptide (e.g., after a treatment period of time for 1 month to 1 year).

The subject may exhibit decreased reliance on an assistive mobility device (e.g., walker, a wheelchair, braces, crutches, and orthotics) after administration of the recombinant polypeptide.

Prior to administration of the recombinant polypeptide, the subject may be characterized as having a plasma PPi concentration of about 4.5 µM or greater. Administration of the recombinant polypeptide may promote a median decrease in PPi concentration in a plasma sample from the subject of at least about 1 µM. The subject may exhibit a plasma PPi concentration of about 2 µM to about 5 µM after administration of the recombinant polypeptide.

In some embodiments, the subject is 0 to 14 days of age and, prior to administration of the recombinant polypeptide, is characterized as having a plasma ALP concentration of about 90 U/L or less; the subject is 15 days to less than 1 year of age and, prior to administration of the recombinant polypeptide, is characterized as having a plasma ALP concentration of about 134 U/L or less; the subject is about 1 year to less than 10 years of age and, prior to administration of the recombinant polypeptide, is characterized as having a plasma ALP concentration of about 156 U/L or less; the subject is about 10 years to about 13 years of age and, prior to administration of the recombinant polypeptide, is characterized as having a plasma ALP concentration of about 141 U/L or less; the subject is female and about 13 years to about 15 years of age and, prior to administration of the recombinant polypeptide, is characterized as having a plasma ALP concentration of about 62 U/L or less; the subject is male and about 13 years to about 15 years of age and, prior to administration of the recombinant polypeptide, is characterized as having a plasma ALP concentration of about 127 U/L or less; the subject is female and about 15 years to about 17 years of age and, prior to administration of the recombinant polypeptide, is characterized as having a plasma ALP concentration of about 54 U/L or less; the subject is male and about 15 years to about 17 years of age and, prior to administration of the recombinant polypeptide, is characterized as having a plasma ALP concentration of about 89 U/L or less; the subject is about 17 years of age or older and, prior to administration of the recombinant polypeptide, is characterized as having a plasma ALP concentration of about 48 U/L or less; or the subject is about 17 years of age or older and, prior to administration of the recombinant polypeptide, is characterized as having a plasma ALP concentration of about 59 U/L or less.

Administration of the recombinant polypeptide may promote a median increase in ALP concentration in a plasma sample from the subject of at least about 100 U/L or greater.

In some embodiments, the subject is 0 to 14 days of age and, after administration of the recombinant polypeptide, is characterized as having a plasma ALP concentration of about 273 U/L or greater; the subject is 15 days to less than 1 year of age and, after administration of the recombinant polypeptide, is characterized as having a plasma ALP concentration of about 518 U/L or greater; the subject is about 1 year to less than about 10 years of age and, after administration of the recombinant polypeptide, is characterized as having a plasma ALP concentration of about 369 U/L or greater; the subject is about 10 years to about 13 years of age and, after administration of the recombinant polypeptide, is characterized as having a plasma ALP concentration of about 460 U/L or greater; the subject is female and about 13 years to about 15 years of age and, after administration of the recombinant polypeptide, is characterized as having a plasma ALP concentration of about 280 U/L or greater; the subject is male and about 13 years to about 15 years of age and, after administration of the recombinant polypeptide, is characterized as having a plasma ALP concentration of about 517 U/L or greater; the subject is female and about 15 years to about 17 years of age and, after administration of the recombinant polypeptide, is characterized as having a plasma ALP concentration of about 128 U/L or greater; the subject is male and about 15 years to about 17 years of age and, after administration of the recombinant polypeptide, is characterized as having a plasma ALP concentration of about 365 U/L or greater; the subject is female and about 17 years of age or older and, after administration of the recombinant polypeptide, is characterized as having a plasma ALP concentration of about 95 U/L or greater; or the subject is male and about 17 years of age or older and, after administration of the recombinant polypeptide, is characterized as having a plasma ALP concentration of about 164 U/L or greater.

Prior to administration of the recombinant polypeptide, the subject may be characterized as having an average Bruininks-Oseretsky Test of Motor Proficiency 2nd Edition (BOT-2) strength score of about 10 or less. Prior to administration of the recombinant polypeptide, the subject may be characterized as having an average BOT-2 running speed and agility score of about 5 or less. Administration of the recombinant polypeptide may result in an average BOT-2 strength score of the subject of about 10 or more. Administration of the recombinant polypeptide may result in an average BOT-2 running speed and agility score of the subject of about 5 or more.

Prior to administration of the recombinant polypeptide, the subject may be characterized as having an average Childhood Health Assessment Questionnaire (CHAQ) index score of about 0.8 or more. Administration of the recombinant polypeptide may result in an average CHAQ index score of the subject of about 0.5 or less.

Prior to administration of the recombinant polypeptide, the subject may be characterized as having an average Pediatric Outcomes Data Collection Instrument (PODCI) score of about 40 or less. Administration of the recombinant polypeptide may result in an average PODCI score of the subject of about 40 or more.

Prior to administration of the recombinant polypeptide, the subject may be characterized as having an average Muscle Strength Grade of less than about 5. Administration of the recombinant polypeptide results in an average increase in a Muscle Strength Grade of the subject of about 1 or more.

Prior to administration of the recombinant polypeptide, the subject may be characterized as having an average Hand Held Dynamometry (HHD) value of less than about 80% of a predicted HHD value. Administration of the recombinant polypeptide may result in an average HHD value of the subject of about 80% or more of a predicted HHD value. The HHD value may represent the grip strength, knee flexion, knee extension, hip flexion, hip extension, or hip abduction of the subject.

In another aspect, the invention features a method for determining an activity (e.g., binding activity) of a polypeptide described herein that includes a sALP or sALP fusion polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). The method may include providing a bone homogenate, e.g., derived from a bone (e.g., a femur, such as a bone from, e.g., a mammal (e.g., a mouse or a human)). The bone homogenate may be obtained by taking bone tissue and treating the tissue, e.g., with a collagenase to remove connective tissue. The bone may be purified, e.g., by removing marrow and/or other contaminants. Once the bone is dry, the bone may be homogenized, e.g., by grinding, crushing, and/or slicing the bone, e.g., until the bone tissue is homogenized. The bone homogenate then may be resuspended in a liquid, e.g., in PBS, for use in a subsequent assay. A polypeptide as described herein may be incubated with the homogenate, e.g., for at least 1 minute, 5 minutes, 10 minutes, 15 minutes, 20 minutes, 25 minutes, 30 minutes, 45 minutes, 1 hour, 2 hours, 3 hours, 4 hours, 5 hours, 6 hours, or longer. The sample may be then be vortexed and/or centrifuged to obtain a fraction of protein in the supernatant or bound to the bone homogenate. The ratio of bound versus unbound protein can subsequently be measured and quantified to determine binding affinity by the polypeptide for the homogenate.

Definitions

The term "a" or "plurality" before a noun represents one or more of the particular noun. For example, the phrase "a mammalian cell" represents "one or more mammalian cells."

The term "about" is meant to account for variations due to experimental error; in some embodiments "about" represents ±10% of the recited value. All measurements reported herein are understood to be modified by the term "about," whether or not the term is explicitly used, unless explicitly stated otherwise.

The term "bone-targeting moiety" means an amino acid sequence of at least 3 amino acid residues in length having a sufficient affinity to bone matrix such that the bone-targeting moiety, taken alone, has an in vivo binding affinity to the bone matrix that is at least about $1 \times 10^{-5}$ M or better (e.g., about $10^{-6}$ M, about $10^{-7}$ M, about $10^{-8}$ M, about $10^{-9}$ M, or better).

The terms "Brief Pain Inventory-Short Form" and "BPI-SF" as used interchangeably herein refer to a method to measure pain of patients, in particular, patients having HPP (e.g., patients of about 13 years of age or older). The BPI-SF is a self-reported pain measure described in Cleeland & Ryan (*Ann Acad Med Singapore*, 23(2), 129-138; 1994), hereby incorporated by reference in its entirety. The BPI-SF is a questionnaire designed to assess the severity of pain and the impact of pain on daily functions. The BPI-SF consists of 11 items that utilize a numeric rating scale to assess pain severity (4 items) and pain interference (7 items) in the 24 hours prior to questionnaire administration. The BPI-SF questionnaire provides information on the intensity of pain and degree to which the pain interferes with daily functions of the patient (e.g., a HPP patient of about 13 years of age or older) on a numeric rating scale from 0 (no pain) to 10 (severe pain or significant interference caused by pain); lower scores indicate better quality of life outcomes and reduced pain. For instance, BPI-SF scores of the HPP adolescents and adults are a composite of 11 pain assessments.

The terms "Bruininks-Oseretsky Test of Motor Proficiency $2^{nd}$ Edition" and "BOT-2," as used herein, refer to the second edition of a standardized test of gross and fine motor performance for a patient having HPP, e.g., a child having HPP of about 5 years of age to about 12 years of age, an adolescent having HPP of about 13 years of age to about 17 years of age, or an adult having HPP of greater than about 18 years of age or older. See Bruininks, R. H. (2005). *Bruininks-Oseretsky Test of Motor Proficiency*, (BOT-2). Minneapolis, MN: Pearson Assessment, hereby incorporated by reference in its entirety. The BOT-2 is administered individually to assess gross and fine motor skills of a range of patients. The BOT-2, for example, can be used to evaluate physical impairments and mobility restrictions in patients having HPP, e.g., children having HPP of about 5 years of age to about 12 years of age, adolescents having HPP of about 13 years of age to about 17 years of age, or adults having HPP of greater than about 18 years of age or older. The BOT-2 provides composite BOT-2 scores in the following exemplary areas: strength, running speed and agility, fine motor precision, fine motor integration, manual dexterity, bilateral coordination, balance, and upper-limb coordination. For example, a BOT-2 strength total score can be determined by having a patient perform sit-ups, v-ups, standing long jump, wall sit, and push-ups. A running speed and agility total score can be determined by having a patient step over a balance beam or perform a shuttle run, two-legged side hop, or one-legged side hop. Both BOT-2 total strength and BOT-2 running speed and agility total scores range from 0 to 25, in which a score of about 10 to 25 is considered representative of healthy subjects.

The term "catalytically competent," as used herein, refers to a sALP that hydrolyzes the bone mineralization inhibitor inorganic pyrophosphate (PPi) to provide inorganic phosphate (Pi), thereby decreasing the extracellular concentrations of PPi. Thus, the catalytically competent sALP improves skeletal mineralization in bone by regulating the concentration of PPi.

The terms "Childhood Health Assessment Questionnaire" and "CHAQ," as used herein refer to a questionnaire that is used to assess the health state (e.g., ability to perform activities of daily living (ADLs) and incidence of pain) of patients of 1 to 19 years of age, such as children, adolescents, and some adults with HPP. For a description of the CHAQ index, see Bruce & Fries (J. Rheumatol. 30(1): 167-178, 2003), hereby incorporated by reference in its entirety. The CHAQ may be administered by interview or self-report for children greater than 8 years of age. The CHAQ includes eight sub-scales for dressing/grooming, arising, eating, walking, hygiene, reach, grip, and activities. The range of scores within each category is from 0 to 3, in which a score of 0 indicates without any difficulty; a score of 1 indicates with some difficulty; a score of 2 indicates with much difficulty; and a score of 3 indicates that the patient is unable to perform the activity. The CHAQ index may also be used to determine the presence and severity of pain.

The terms "EuroQol five dimension questionnaire" and "EQ-5D," as used herein, refer to a questionnaire that is used to assess the health state (e.g., mobility, self-care, ability to perform usual activities of school, work, or housework, ability to perform ADLs (e.g., dressing, toileting, and cooking), experience of pain or discomfort, and anxiety or depression) of patients, such as children having HPP of about 5 years of age to about 12 years of age, adolescents having HPP of about 13 years of age to about 17 years of age, or adults having HPP of greater than about 18 years of age or older. For a description of the EQ-5D index, see Reenan & Oppe (EQ-5D-3L User Guide Version 5.1, 2015), hereby incorporated by reference in its entirety. The EQ-5D may be self-administered, administered by a clinician, or in an interview. The EQ-5D questionnaire includes the following five dimensions that characterize the health state of the HPP patient: mobility, self-care, ability to perform ADLs, incidence of pain or discomfort, and anxiety or depression. As described herein, the EQ-5D may be used in combination with at least one physical assessment, such as the 6MWT, to categorize an HPP patient as having a health state of level I indicating no problems with physiological condition, level II indicating some problems with physiological condition, level III indicating extreme problems with physiological condition, or level IV indicating the most extreme problems of physiological condition. The EQ-5D can also be used as part of the analysis to assess the transition of an HPP patient from one health state to another health state, such as from a health state of IV to III, IV to II, IV to I, III to II, III to I, or II to I. The Child Health Utility Index-9D (CHU-9D) can also be used to assess health status in HPP patients. For a description of the CHU-9D and EQ-5D indices, see Stevens (Appl Health Econ Health Policy. 9(3): 157-69, 2011) and PCT Publication No. WO 2018/191254, hereby incorporated by reference in its entirety.

The term "efficacy" means the $E_{max}$ value of a compound in a dose-response assay.

The term "Fc" means a fragment crystallizable region of an immunoglobulin, e.g., IgG1, IgG2, IgG3, or IgG4, including the CH2 and CH3 domains of the immunoglobulin heavy chain. Fc may also include any portion of the hinge region joining the Fab and Fc regions. The Fc can be derived from any mammal, including human, and may be post-translationally modified (e.g., by glycosylation or sialylation). In a non-limiting example, Fc can be the fragment crystallizable region of human IgG1 having the amino acid sequence of SEQ ID NO: 259, or Fc can be the fragment crystallizable region of human IgG2/4 of SEQ ID NO: 253.

By "fragment" is meant a portion of a polypeptide or polynucleotide that contains, preferably, at least 10%, 20%, 30%, 40%, 50%, 60%, 70%, 75%, 80%, 85%, 90%, 95%, 96%, 97%, 98%, 99%, or more of the entire length of the reference polynucleotide or polypeptide. A fragment may contain, e.g., 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 500, 600, 700, 800, 900, 1,000, 1100, 1200, 1300, 1400, 1500, 1600, 1700, 1800, 1900, 2000, 2100, or more nucleotides, up to the entire length of the polynucleotide, or 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 400, 500, 600, 700, or more amino acid residues, up to the entire length of the polypeptide.

The terms "Hand Held Dynamometry" and "HHD" as used interchangeably herein refer to a method to measure the grip and muscle strength of subjects, in particular, subjects having HPP of about 13 years of age or older. A dynamometer can be used to assess grip strength, knee flexion, knee extension, hip flexion, hip extension, and hip abduction of a subject having HPP. For example, knee flexion and extension and also hip flexion, extension, and abduction of a subject having HPP of about 13 years of age or older can be measured using, e.g., a MICROFET2™ Dynamometer, while grip strength of the subject can be measured using, e.g., a JAMAR® Grip Dynamometer. In particular, the administrator holds the dynamometer stationary, and the subject exerts a maximal force against the dynamometer. Peak force data is collected in pounds, then converted to Newtons (N). Torque values are then calculated using limb length in N-meters. The torque value can then be compared to the value of, e.g., a normal subject of about the same age, the same gender, and/or the same height, and expressed as a percentage value to generate the HHD score of the subject.

The term "health state," as used herein, refers to the characterized physiological condition of a patient having HPP, such as a child having HPP of about 5 years of age to about 12 years of age, an adolescent having HPP of about 13 years of age to about 17 years of age, or an adult having HPP of greater than about 18 years of age or older. The health state of the HPP patient can be characterized with at least one physical assessment selected from one or more of the following metrics: 6MWT, BOT-2, BSID-III, and gait analysis, and at least one quality of life assessment selected from one or more of the following metrics: EQ-5D, CHAQ, PODCI, CHU-9D, SF-36, SF-12, and PedsQL. In particular, the health state of the HPP patient is characterized by, e.g., the 6MWT in combination with the EQ-5D. After obtaining the results of at least one physical assessment and at least one quality of life assessment selected from the above metrics, the HPP patient may be identified as having a health state of level I indicating no problems with physiological condition, level II indicating some problems with physiological condition, level III indicating extreme problems with physiological condition, or level IV indicating the most extreme problems of physiological condition. The metric(s) can be used to assess transition of the HPP patient from one health state to another health state after, e.g., treatment with an sALP as described herein, such as a transition from a health state of IV to III, IV to II, IV to I, III to II, III to I, or II to I after administration of the sALP.

The terms "hypophosphatasia" and "HPP," as used herein, refer to a rare, heritable skeletal disorder caused by, e.g., one or more loss-of-function mutations in the ALPL (alkaline phosphatase, liver/bone/kidney) gene, which encodes tissue-nonspecific alkaline phosphatase (TNSALP). HPP may be further characterized as infantile HPP, childhood HPP, perinatal HPP (e.g., benign perinatal HPP or lethal perinatal HPP), odonto-HPP, adolescent HPP, or adult HPP. For instance, "childhood HPP describes a patient having HPP that is about 5 years of age to about 12 years, "adolescent HPP" describes a patient having HPP that is about 13 years of age to about 17 years, and "adult HPP" describes a patient having HPP that is about 18 years of age or older. The term "adult HPP," as used herein, refers to a condition or phenotype characterized by the presence of one or more of the following symptoms: elevated blood and/or urine levels of inorganic pyrophosphate (PPi), hypomineralization, hypercalciuria, one or more skeletal deformities, hypotonia, muscle weakness, rheumatoid complications, waddling gait, ambulatory difficulties, bone pain, pain, bone fracture, calcium pyrophosphate dihydrate crystal deposition, pseudogout, arthritis, pyrophosphate arthropathy, chondrocalcinosis, calcific periarthritis, and pseudofracture. The term "adolescent HPP," as used herein, refers to a condition or phenotype characterized by the presence of one or more of the following symptoms: elevated blood or urine levels of PPi, PEA, or PLP; osteomalacia, one or more skeletal deformities, hypotonia, muscle weakness, rheumatoid complications, arthritis, pseudogout, waddling gait, ambulatory difficulties, bone pain, pain, premature loss of teeth, hypomineralization, pulmonary hypoplasia, respiratory insufficiency, seizures, hypercalciuria, short stature, and growth delay. The term "childhood HPP," as used herein, refers to refers to a condition or phenotype characterized by the presence of one or more of the following symptoms: elevated blood or urine levels of PPi, PEA, or PLP; rickets, rachitic ribs, one or more skeletal deformities, hypotonia, muscle weakness, rheumatoid complications, arthritis, pseudogout, waddling gait, ambulatory difficulties, bone pain, pain, premature loss of teeth, hypomineralization, delayed motor development, seizures, hypercalciuria, short stature, bone fracture, pseudofracture, and growth delay.

The terms "Lower Extremity Function Scale" and "LEFS" as used interchangeably herein refer to a method to measure the functional disability in the lower extremities of patients, in particular, patients having HPP (e.g., patients of about 13 years of age or older). The LEFS is a self-reported measure described in Binkley et al. (*Phys Ther.* 79:371-83, 1999), hereby incorporated by reference in its entirety. Total LEFS scores range from 0 to 80 with higher scores indicative of better lower extremity functioning. A LEFS score change of about 9 points is considered a clinically meaningful change. A licensed physical therapist can administer the LEFS to HPP patients (e.g., HPP patients of about 13 years of age or older) in interview format. Higher LEFS scores are indicative of improved lower extremity functioning including transitional movements (e.g., getting out of bath or rolling in bed), locomotion (e.g., walking or running on uneven ground), climbing stairs, and squatting. The LEFS can be used to evaluate the functional impairment of one or both lower extremities of an HPP patient, including the ability to monitor the patient over time and evaluate the effectiveness of asfotase alfa treatment.

The terms "nucleic acid," "nucleic acid molecule," and "polynucleotide" mean a polymeric molecule, e.g., RNA or DNA, having a sequence of two or more covalently bonded, naturally occurring or modified, nucleotides. The nucleic acid molecule may be, e.g., single or double stranded, and may include modified or unmodified nucleotides, or mixtures or combinations thereof. Various salts, mixed salts, and free acid forms of nucleic acid molecules are also included.

The terms "Pediatric Outcomes Data Collection Instrument" and "PODCI," as used herein, refer to a questionnaire used to assess overall health, incidence of pain, and ability to perform ADLs of patients under 19 years of age, particularly in patients with chronic health disorders, such as patients with HPP. For a description of the PODCI, see Plint et al. (*J. Pediatr. Orthop.* 23(6): 788-790, 2003), hereby incorporated by reference in its entirety. The questionnaire may be completed by the patient or by a parent/guardian of the patient with knowledge of the patient's condition. The eight scales generated from the PODCI include the following: 1) the upper extremity and physical function scale to measure difficulty encountered in performing daily personal care and student activities; 2) the transfer and basic mobility scale to measure difficulty experienced in performing routine motion and motor activities in daily activities; 3) the sports/physical functioning scale to measure difficulty or limitations encountered in participating in more active activities or sports; 4) the pain/comfort scale to measure the level of pain experienced during the past week; 5) the treatment expectations scale to measure the long term expectations of treatment; 6) the happiness scale to measure overall satisfaction with personal looks and sense of similarity to friends and others of own age; 7) the satisfaction with symptoms scale to measure the patient's acceptance of current limitations should this be a life-long state; and 8) the global functioning scale, which is a general combined scale calculated from the first four scales listed above. Standardized scores are generated from a series of questions in the PODCI and converted to a 0 to 100 scale, in which 0 represents significant disability and 100 represents less disability.

The term "recombinant protein" is known in the art. A recombinant protein can be a glycoprotein. For example, recombinant protein or a recombinant protein variant made in a CHO cell is glycosylated, with the sugar moieties covalently attached on the protein, and is a glycoprotein. Briefly, the term "recombinant protein" can refer to a protein that can be manufactured using a cell culture system. The cells in the cell culture system can be derived from, for example, a mammalian cell, including a human cell, a CHO cell, an insect cell, a yeast cell, or a bacterial cell. In general, the cells in the cell culture contain an introduced polynucleotide encoding the recombinant protein of interest (which polynucleotide can be borne on a vector, such as a plasmid vector). The polynucleotide encoding the recombinant protein can also contain a heterologous promoter operably linked to a polynucleotide encoding the protein.

As used herein, "Six Minute Walk Test" and "6MWT" refer to a physical assessment that is a standardized test to assess walking ability of a patient having HPP (e.g., a child having HPP of about 5 years of age to about 12 years of age, an adolescent having HPP of about 13 years of age to about 17 years of age, or an adult having HPP of greater than about 18 years of age or older). In particular, walking ability refers to the ability of the patient to lift and set down each foot in turn. See the American Thoracic Society statement: guidelines for the six-minute walk test (*Amer. J. of Respiratory and Critical Care Medicine,* 166(1):111-7, 2002, hereby incorporated by reference in its entirety). The 6MWT is determined from the distance (e.g., in meters) that a patient walks on a flat, hard surface in a period of six minutes. The 6MWT distance can then be compared to the 6MWT distance of the patient at baseline, the 6MWT distance of an untreated subject (e.g., an untreated subject of about the same age, height, and/or gender), or the 6MWT distance of a healthy subject (e.g., a healthy subject of about the same age, height, and/or gender) and expressed as a percentage to determine the 6MWT value.

By "treating," "treat," and "treatment" is meant the medical management of a patient with the intent to cure, ameliorate, stabilize, reduce the likelihood of, or prevent a disease condition, such as HPP (e.g., child, adolescent, or adult HPP), or one or more symptoms thereof and/or the management of a patient exhibiting or likely to have a disease condition, such as HPP, e.g., by administering a pharmaceutical composition (e.g., an sALP as described herein). This term includes active treatment, that is, treatment directed specifically toward the improvement or associated with the cure of a disease, pathological condition, disorder, or event, and also includes causal treatment, that is, treatment directed toward removal of the cause of the associated disease, pathological condition, disorder, or event. In addition, this term includes palliative treatment, that is, treatment designed for the relief or improvement of at least one symptom rather than the curing of the disease, pathological condition, disorder, or event; symptomatic treatment, that is, treatment directed toward constitutional symptoms of the associated disease, pathological condition, disorder, or event; preventative treatment, that is, treatment directed to minimizing or partially or completely inhibiting the development of the associated disease, pathological condition, disorder, or event, e.g., in a patient who is not yet ill, but who is susceptible to, or otherwise at risk of, a particular disease, pathological condition, disorder, or event; and supportive treatment, that is, treatment employed to supplement another specific therapy directed toward the improvement of the associated disease, pathological condition, disorder, or event.

The terms "peptide," "polypeptide," and "protein" are used interchangeably and refer to any chain of two or more natural or unnatural amino acid residues, regardless of post-translational modification (e.g., glycosylation, sialylation, or phosphorylation), constituting all or part of a naturally-occurring or non-naturally occurring polypeptide or peptide, as is described herein.

The terms "ALP," "sALP," "soluble alkaline phosphatase," "alkaline phosphatase," and "extracellular domain of an alkaline phosphatase" are used interchangeably (unless the context indicates otherwise), and mean a soluble, non-membrane-bound alkaline phosphatase or a domain, biologically active fragment, or biologically active variant thereof. ALPs include, for example, an alkaline phosphatase lacking a C-terminal GPI signal sequence, and additional variants and analogs thereof which retain alkaline phosphatase activity, e.g., the ability to hydrolyze PPi or other natural or artificial substrates. This includes TNSALP, PALP, GALP, and IALP domain, and biologically active fragment, or biologically active variant thereof, unless specified otherwise. A mature sALP lacks the GPI membrane anchor and the signal peptide, which is cleaved during processing.

The term "ALP polypeptide" is meant any sequence including an ALP sequence, as defined herein. Exemplary ALP polypeptides include those having the structure A-ALP-B, wherein each of A and B is absent, or is an amino acid sequence of at least one amino acid (e.g., any ALP fusion polypeptide described herein).

The term "isolated" or "purified" means separated from other naturally accompanying components. Typically, a compound (e.g., protein, polypeptide, polynucleotide, or small molecule), factor, cell, or other component is considered isolated when it is at least, e.g., 50%, 60%, 70%, 75%, 80%, 85%, 90%, 95%, 96%, 97%, 98%, or even 99%, by weight, free from proteins, antibodies, naturally-occurring organic molecules, and other components with which it is naturally associated. In some instances, the component is at least 75%, 90%, or even 99%, by weight, pure. An isolated component may be obtained by chemical synthesis, separation of the factor from natural sources, or production of the component in a recombinant host cell that does not naturally produce the component. Proteins and small molecules may be purified by one skilled in the art using standard techniques such as those described by Ausubel et al. (*Current Protocols in Molecular Biology*, John Wiley & Sons, New York, 2000). The component is preferably at least, e.g., 2, 5, or 10 times as pure as the starting material, as measured using, e.g., polyacrylamide gel electrophoresis, column chromatography, optical density, HPLC analysis, or Western analysis (Ausubel et al., 2000). Exemplary methods of purification are column chromatography, filtration, immunoprecipitation, and magnetic bead immunoaffinity purification.

The term "pharmaceutically acceptable carrier" or "pharmaceutically acceptable excipient" meas a carrier or excipient that is physiologically acceptable to the treated patient while retaining the therapeutic properties of the compound with which it is administered. One exemplary pharmaceutically acceptable carrier substance is physiological saline. Other physiologically acceptable carriers and their formulations are known to those skilled in the art and described, for example, in *Remington* (The Science and Practice of Pharmacy, 22nd Ed., Allen, Ed. 2012).

The term "pharmaceutical composition" means a composition containing a polypeptide or polynucleotide as described herein formulated with a pharmaceutically acceptable excipient, and includes those that are manufactured or sold with the approval of a governmental regulatory agency as part of a therapeutic regimen for the treatment or prevention of a disease or event in a patient. Pharmaceutical compositions can be formulated, for example, for subcutaneous administration, intravenous administration (e.g., as a sterile solution free of particulate emboli and in a solvent system suitable for intravenous use), for oral administration (e.g., a tablet, capsule, caplet, gelcap, or syrup), or any other formulation described herein, e.g., in unit dosage form.

The term "subject" or "patient" means a mammal, including, but not limited to, a human or non-human mammal, such as a bovine, equine, canine, ovine, or feline.

The term "mammalian cell" is known in the art and can refer to any cell from or derived from any mammal including, for example, a human, a hamster, a mouse, a green monkey, a rat, a pig, a cow, a hamster, or a rabbit. The mammalian cell can be an immortalized cell, a differentiated cell, or an undifferentiated cell.

The term "therapeutically effective amount" means an amount of a polypeptide or polynucleotide described herein that is sufficient to substantially treat, prevent, delay, suppress, or arrest any symptom of a disease or condition described herein, particularly HPP. A therapeutically effective amount of a composition described herein may depend on the severity of the disorder being treated and the condition, weight, and general state of the subject and can be determined by an ordinarily-skilled artisan with consideration of such factors. A therapeutically effective amount of a composition described herein can be administered to a subject in a single dose or in multiple doses administered over a period of time.

As used herein, when a polypeptide or nucleic acid sequence is referred to as having "at least X % sequence identity" to a reference sequence, it is meant that at least X percent of the amino acid residues or nucleotides in the polypeptide or nucleic acid are identical to those of the reference sequence when the sequences are optimally aligned. An optimal alignment of sequences can be determined in various ways that are within the skill in the art, for instance, the Smith Waterman alignment algorithm (Smith et al., *J. Mol. Biol.* 147:195-7, 1981) and BLAST (Basic Local Alignment Search Tool; Altschul et al., *J. Mol. Biol.* 215: 403-10, 1990). These and other alignment algorithms are accessible using publicly available computer software such as "Best Fit" (Smith and Waterman, *Advances in Applied Mathematics*, 482-489, 1981) as incorporated into GeneMatcher Plus™ (Schwarz and Dayhof, *Atlas of Protein Sequence and Structure*, Dayhoff, M. O., Ed., pp 353-358, 1979), BLAST, BLAST-2, BLAST-P, BLAST-N, BLAST-X, WU-BLAST-2, ALIGN, ALIGN-2, CLUSTAL, or Megalign (DNASTAR). In addition, those skilled in the art can determine appropriate parameters for measuring alignment, including any algorithms needed to achieve optimal alignment over the length of the sequences being compared.

The words "preferred" and "preferably" refer to embodiments of the disclosed compounds, compositions and methods that may afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the disclosure.

For any method disclosed herein that includes discrete steps, the steps may be conducted in any feasible order; also, as appropriate, any combination of two or more steps may be conducted simultaneously.

The above summary is not intended to describe each disclosed embodiment or every implementation of disclosed compounds, compositions and methods. The description that follows more particularly exemplifies illustrative embodiments. In several places throughout the application, guidance may be provided through lists of examples, which examples can be used in various combinations. In each instance, the recited list serves only as a representative group and should not be interpreted as an exclusive list.

All headings are for the convenience of the reader and should not be used to limit the meaning of the text that follows the heading, unless so specified.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIGS. 1A-1D are graphs showing fluorescent Fc-fusion protein (dimeric fusion proteins consisting of N-terminal HA-binding sequences fused to human IgG1 Fc-Katushka 2s fluorescent protein) binding to hydroxyapatite (HA) or bone homogenate. FIG. 1A shows fluorescent intensity of fluorescent Fc-fusion proteins bound to CAPTAL® HA, normalized to untargeted Fc-Katushka 2s sample (FLU002); FIG. 1B shows fluorescence intensity of protein suspensions after incubation with HA for 2 hours, representing the total amount of unbound protein after incubation; FIG. 1C (bound) and FIG. 1D (unbound) show analogous quantitation of fluorescent Fc-fusion binding to murine C56BL/6 femur bone homogenate. N=2±max/min (*$p<0.05$ vs. FLU002, one-way ANOVA, Dunnet's post-hoc analysis).

FIG. 5A shows whole body regions of interest drawn and total radiant efficiencies quantitated. FIG. 5B shows total radiant efficiencies within spinal regions of interest drawn and radiant efficiencies quantitated and plotted longitudinally throughout the 18-day study. N=6±SD, *$p<0.05$, **$p<0.01$ Mann-Whitney unpaired t test, two-tailed.

FIG. 6A shows raw total radiant efficiencies of tissue specimens from ALP-Fc-$D_{10}$ (ALP031; SEQ ID NO: 31) and ALP-Fc (ALP086; SEQ ID NO: 222) treated mice 18-days post single dose administration. FIG. 6B shows volume-normalized total radiant efficiencies of ex vivo bone tissues from mice treated with ALP-Fc-$D_{10}$ (ALP031; SEQ ID NO: 31). N=6±SD, **$p<0.01$ Mann-Whitney unpaired t test, two-tailed.

FIG. 9A shows spines, FIG. 9B shows hind limbs, and FIG. 9C shows skulls, which were harvested from all mice from all treatment groups seven days (168 hours) after single dose injections. Equivalent regions of interest (ROIs) were drawn around similar tissues and total radiant efficiencies were normalized to tissue volume. N=5±SD, *** p<0.001, one-way ANOVA, Tukey's post-hoc analysis.

FIG. 10A shows bone homogenate bound protein for VHH001 (SEQ ID NO: 249), VHH002 (SEQ ID NO: 250), and ALP-Fc-$D_{10}$ (ALP031; SEQ ID NO: 31) and FIG. 10B shows unbound protein for VHH001 (SEQ ID NO: 249), VHH002 (SEQ ID NO: 250), and ALP-Fc-$D_{10}$ (ALP031; SEQ ID NO: 31).

DETAILED DESCRIPTION

Figure 1A:
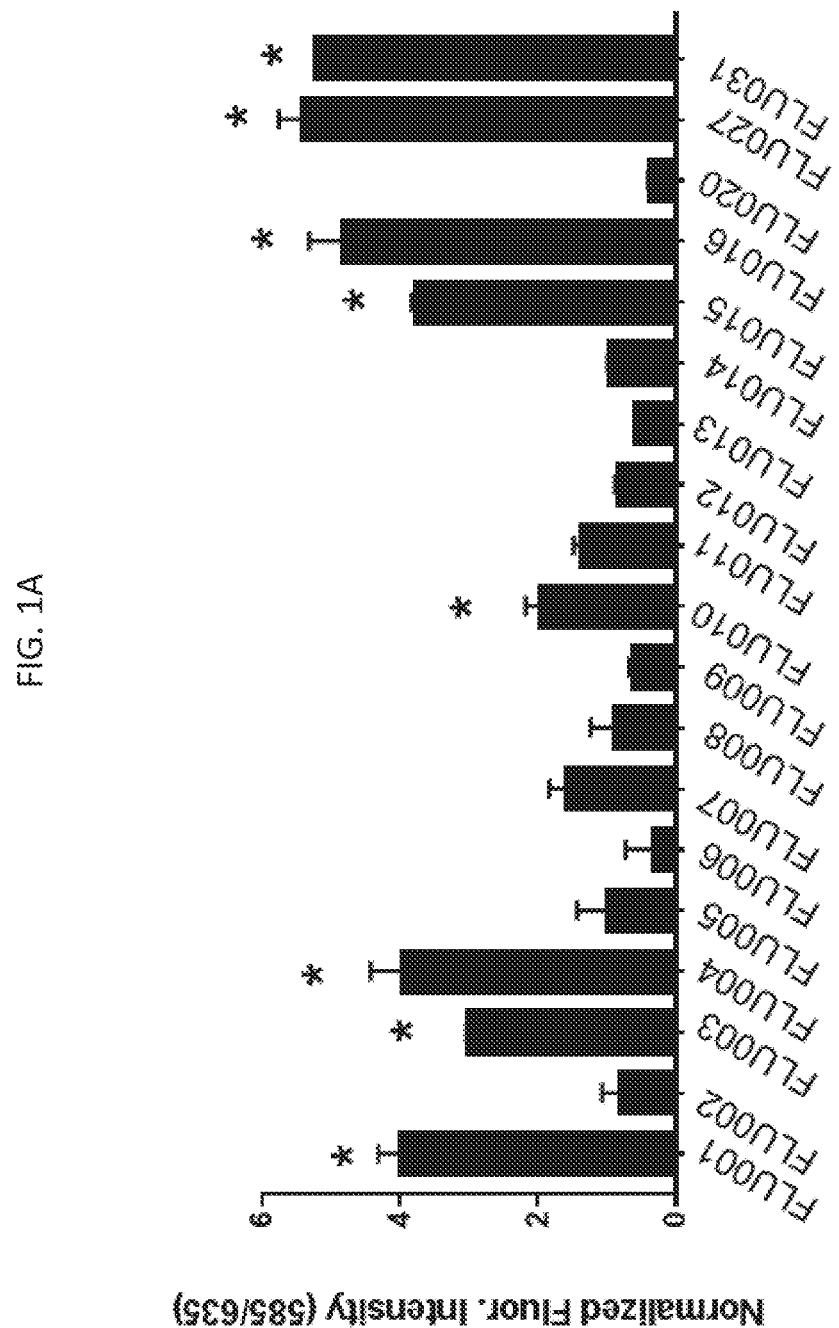

Featured are polypeptides that include soluble alkaline phosphatases, fragments, fusion proteins thereof, and methods of use thereof, for treating bone mineralization disorders, such as hypophosphatasia (HPP), and symptoms thereof. The polypeptides include a soluble alkaline phosphatase (sALP) or fragment thereof, which is derived from a naturally occurring alkaline phosphatase (ALP). Alkaline phosphatases include various isozymes that are differentially expressed in different tissues. Four major ALP isozymes include tissue non-specific alkaline phosphatase (TNSALP), placental alkaline phosphatase (PALP), germ line alkaline phosphatase (GALP), and intestinal alkaline phosphatase (IALP). Accordingly, featured are proteins derived from these ALP isozymes.

HPP is a rare, heritable skeletal disease with an incidence of 1 per 100,000 births for the most severe forms of the disease. The disorder typically results from loss-of-function mutations in the gene coding for TNSALP. HPP exhibits a remarkable range of symptoms and severity, from premature tooth loss to almost complete absence of bone mineralization in utero. The presentation of HPP varies markedly among subjects and also varies markedly between subject ages. Many subjects having HPP display skeletal changes, short stature, chronic pain, painful lower limbs, gait disturbance, and premature, atraumatic tooth loss. Due to the loss-of-function mutation in the endogenous TNSALP, a subject with HPP requires functional ALP activity of the polypeptides described herein to restore the native ALP activity and provide normal bone matrix mineralization.

We systematically examined protein activity, protein stability, and pharmacokinetic properties of alkaline phosphatase polypeptides and fusion proteins thereof by performing site-directed mutagenesis. Variations in the alkaline phosphatase polypeptides and fusion proteins thereof described herein include changes in amino acid residues located in and around the active site of the alkaline phosphatase enzyme, at one or more consensus sites of N-linked glycosylation, in a bone targeting moiety, if included, and/or in the fragment crystallizable (Fc) region, if included. Disclosed herein are alkaline phosphatase polypeptides and fusion proteins thereof containing one or more of these changes and data showing that the change(s) improve one or more of protein activity, protein stability, and pharmacokinetic properties. The alkaline phosphatase polypeptides and fusion proteins thereof are described in more detailed herein.

Soluble Alkaline Phosphatases

Featured are polypeptides containing ALPs, including naturally occurring ALPs and fragments thereof and ALPs with one or more mutations that improve at least one activity or pharmacokinetic (PK) property relative to the naturally occurring ALP without the at least one mutation.

The ALP may be a soluble fragment of TNSALP, PALP, GALP, or IALP, or a chimera thereof. The ALP may be from any suitable organism, and may be, e.g., a mammalian ALP. Mammalian ALPs include, for example, human, gorilla, mouse, rabbit, chimp, cynomolgus macaque, rhesus macaque, orangutan, baboon, rat, bovine, goat, and llama ALP. In some particular embodiments, the ALP is a human ALP, such as human TNSALP or human IALP. The ALP may have at least 70% (e.g., 75%, 80%, 85%, 90%, 95%, 97%, 99%, or 100%) sequence identity to any one of SEQ ID NOs: 1-6 (e.g., at least 85% sequence identity to residues 1-491 of SEQ ID NO: 1 or residues 1-486 of SEQ ID NO: 4). The ALP may have at least 70% (e.g., 75%, 80%, 85%, 90%, 95%, 97%, 99%, or 100%) sequence identity to a region of at least 50 (e.g., at least 100, 150, 200, 250, 300, 350, 400, 450, or more) amino acids of any one of SEQ ID NOs: 1-6.

TNSALP is a membrane-bound protein anchored by a glycolipid moiety at the C-terminus (Swiss-Prot, P05186). The glycolipid anchor (GPI) is added post-translationally after the removal of a hydrophobic C-terminal end, which serves both as a temporary membrane anchor and as a signal for the addition of the GPI. While the GPI anchor is located in the cell membrane, the remaining portions of TNSALP are extracellular. In particular, TNSALP (e.g., human TNSALP (hTNSALP)) can be engineered to replace the first amino acid of the hydrophobic C-terminal sequence (an alanine) with a stop codon, thereby producing an engineered soluble TNSALP that contains all amino acid residues of the native anchored form of TNSALP, but lacking the GPI membrane anchor. One skilled in the art will appreciate that the position of the GPI membrane anchor will vary in different ALPs and can include, e.g., the last 10, 12, 14, 16, 18, 20, 21, 22, 23, 24, 25, 26, 27, 28, 29, 30, 32, 34, 36, 38, 40, 45, 50, or more amino acid residues on the C-terminus of the polypeptide. Thus, the C-terminal end of the native ALP can be truncated by certain amino acids without affecting ALP activity.

In addition to the C-terminal GPI anchor, TNSALP also has an N-terminal signal peptide sequence. The N-terminal signal peptide is present on the protein when it is synthesized, but is cleaved from TNSALP after translocation into the endoplasmic reticulum. An exemplary N-terminal signal peptide is MISPFLVLAIGTCLTNS (SEQ ID NO: 251).

The sALPs described herein include both secreted (i.e., lacking the N-terminal signal) and non-secreted (i.e., having the N-terminal signal) forms thereof. One skilled in the art will appreciate that the position of the N-terminal signal peptide will vary in different alkaline phosphatases and can include, for example, the first 5, 8, 10, 11, 12, 13, 14, 15, 16, 17, 18, 19, 20, 21, 22, 23, 24, 25, 27, 30, or more amino acid residues on the N-terminus of the polypeptide. One of skill in the art can predict the position of a signal sequence cleavage site, e.g., by an appropriate computer algorithm, such as that described in Bendtsen et al. (*J. Mol. Biol.* 340(4):783-795, 2004) and available at cbs.dtu.dk/services/SignalP/.

The ALP may include one or more mutations, e.g., a mutation that is a non-naturally occurring mutation. The one or more mutations preferably enhance a therapeutic feature of the alkaline phosphatase and/or the bone targeting conjugate. For example, the one or more mutations can improve the clearance rate, activity, efficacy, and/or solubility of the bone targeting conjugate. The mutation can be an amino acid substitution, or the insertion or deletion of one or more amino acids. The one or more mutations may improve at least one activity of pharmacokinetic (PK) property relative to the naturally occurring ALP without the at least one mutation. The ALP (e.g., human TNSALP) may have at least one mutation selected from the group consisting of E108X, M384X, L385X, N213X, and N286X relative to SEQ ID NO: 1, in which X is any amino acid. The one or more mutations may include, e.g., E108S, E108T, E108Q, E108M, E108K, E108L, M384R, L385T, N213Q, and N286Q relative to SEQ ID NO: 1. The ALP may include more than one (e.g., 2, 3, 4, 5, 6, 7, 8, 9, 10, or more) mutations at different amino acid positions. For example, the ALP may include E108M, N213Q, and N286Q mutations relative to SEQ ID NO: 1. The ALP (e.g., human IALP) may have a W245X mutation relative to SEQ ID NO: 4, in which X is any amino acid. The ALP may have a W245R mutation relative to SEQ ID NO: 4. The ALP may have a C481X mutation relative to SEQ ID NO: 4, in which X is any non-thiol containing amino acid (e.g., C481G).

The polypeptides described herein may contain an ALP that includes a mutation relative to a naturally occurring ALP that is present within a specified region of the ALP. The mutation may be present in the ectodomain of ALP. For example, the mutation may be present in the crown domain, the catalytic domain or the dimerization domain of the ALP. The mutation may be present in the GPI anchor domain, if included. The polypeptide may include a mutation that is present within amino acids 1-491 or 1-486 of a human TNSALP or an analogous ALP position based on alignment and/or sequence homology. For example, the polypeptide may have a mutation within positions 1-491, 1-486, 25-475, 25-240, 50-400, 50-350, and/or 100-300 relative to SEQ ID NO: 1. The polypeptide may have a mutation within positions 100-125, 100-110, 200-225, 210-220, 275-300, 280-290, 425-450, and/or 425-435 relative to SEQ ID NO: 1. For example, the polypeptide may have a mutation between positions 108, 213, 286, and/or 429 relative to SEQ ID NO: 1. In certain embodiments, the mutation is within the sequence of the ALP and the mutation is not a stretch of non-natural amino acids present at the N- or C-terminal domain of the ALP.

The ALP may have a mutation at a consensus N-linked glycosylation site. Consensus N-linked glycosylation sites include asparagine-X-Z motifs, in which X is any amino acid except P, and Z is any amino acid except S or T. The asparagine may be mutated to a glutamine.

The ALP may have a S429X mutation relative to SEQ ID NO: 4, wherein X is any amino acid. For example, the ALP may have an S429Q, S429H, S429E, or S429D mutation relative to SEQ ID NO:4.

The ALP may have at least 70% (e.g., 75%, 80%, 85%, 90%, 95%, 97%, 99%, or 100%) sequence identity to a region of at least 50 (e.g., 100, 150, 200, 250, 350, 400, or more) amino acids of any one of SEQ ID NOs: 7-223, 247, and 262-264 and or may include or or more of the mutations discussed above.

The mutant ALP may provide improvement in at least one activity of PK property relative to the naturally occurring ALP. For example, the mutation may provide one or more of increased catalytic activity, increased temperature stability, increased zinc binding, maintenance of activity in a zinc depleted buffer, maintenance of activity at a pH of 5.0-7.5, decreased dimerization, decreased aggregation, and/or increased manufacturability of the ALP. The increased catalytic activity may include increased hydrolysis of pyridoxal 5-phosphate and/or pyrophosphate. The increased catalytic activity may be at least 2-fold (e.g., 3-fold, 4-fold, 5-fold, 6-fold, 7-fold, 8-fold, 9-fold, 10-fold, 20-fold, 30-fold, 40-fold, 50-fold, e.g., about 2-fold to about 30-fold) better than the activity of the naturally occurring ALP. The improved PK property may include one or more of increased substrate specificity, increased activity against a native substrate, increased activity against an artificial substrate, decreased Km for a native substrate, and increased area under the curve (AUC) per dose. Artificial ALP substrates include, for example, umbelliferyl phosphate (e.g., 4-methylumbelliferyl phosphate (4-MUP)), umbelliferone phosphate, and paranitrophenyl phosphate (pNPP). Native substrates include, for example, pyridoxal-5'-phosphate, PLP, and PEA.

The ALPs described herein may be in dimeric form. Alternatively, the ALPs may be in a monomeric form.

Bone Targeting Moieties

The polypeptides described herein may further include a bone targeting moiety. A bone targeting moiety is any sequence of amino acids that has a sufficient affinity for bone (e.g., the hydroxyapatite mineral phase of bone). The mineral phase of bone contains positively charged proteins. Therefore, negatively charged amino acids, such as glutamate or aspartate, may target a polypeptide to bone. The bone targeting moiety allows the sALP to localize to bone tissue and remain bound until activity of the sALP diminishes. This allows the sALP to catalyze hydroxyapatite bone formation at the location of native TNSALP.

The bone targeting moiety may be positioned N-terminal or C-terminal to the ALP. The bone targeting moiety may include poly aspartate (Dn), poly glutamate (En), poly (aspartate-alanine-aspartate) (DAD)n, poly (aspartate-aspartate-serine) (DDS)n, poly (aspartate-serine-serine (DSS)n, poly (glutamate-glutamate-serine) (EES)n. n can be any integer from 1 to 50 (e.g., 1 to 30, 3 to 30, 3 to 20, 5 to 16, 10 to 16, e.g., 1, 2, 3, 4, 5, 6, 7, 8, 9, 10, 11, 12, 13, 14, 15, 16, 17, 18, 19, 20, 21, 22, 23, 24, 24, 26, 27, 28, 29, 30, 31, 32, 33, 34, 35, 36, 37, 38, 39, 40, 41, 42, 43, 44, 45, 46, 47, 48, 49, and 50). In some embodiments, the bone targeting moiety may include the structure Dn where n=7 to 10; En where n=10 to 15; (DAD)n where n=2 to 4; (DDS)n where n=2 to 4; (DSS)n where n=3; or (EES)n where n=3 to 4.

The targeting sequence may include Dn, where n is, e.g., 3-9, 17-30, 10-16, or 3-30. The targeting sequence may include En, where n is, for example, 3-9, 17-30, 10-16, or 3-30. The bone targeting moiety may include a sequence containing both aspartate residues and glutamate residues.

Optionally, other amino acids, such as one or more of Thr, Gly, Gln, Asn, Lys, Ser, and/or Ala, can be included within the Dn or En bone targeting sequences. As a non-limiting example, the targeting moiety can include (DDS)n, where n is 2, 3, 4, 5, 6, 7, 8, 9, or 10.

The bone targeting moiety may include all or a portion of a bone targeting sequence from statherin, a salivary protein known to bind bone mineral. An example of a statherin bone targeting sequence is DDSEEKFLRRIGRFG (SEQ ID NO: 252). The bone targeting sequence can include a Dn or En sequence conjugated to a bone targeting sequence from statherin.

Optionally, for any of the bone targeting conjugate embodiments described herein, the targeting sequence can be flanked at the N-terminus, the C-terminus, or both by a cysteine residue. A cysteine residue can be used for conjugation of the polypeptide to another chemical moiety.

Figure 20:
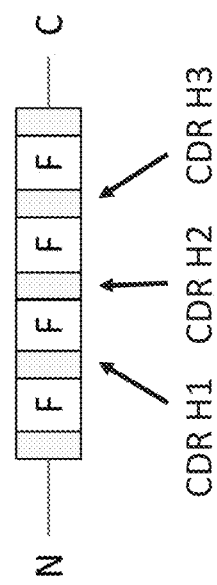
FIG. 20 is a schematic drawing showing an exemplary VHH domain. F represents VHH framework regions, and the gray areas represent CDRs H1, H2, and H3, and end segments, which may be used for positioning or spacing the bone targeting sequences.

The bone targeting moiety may include a VHH antibody or fragment thereof that includes a bone targeting sequence. The bone targeting sequence may be positioned within and/or at the terminus of a VHH antibody fragment to yield a bone targeted VHH construct. A VHH antibody fragment includes all or a portion of the variable domain (VHH) of a heavy chain homodimeric IgG, as is found in camelids (e.g., llama). Homodimeric antibodies lack light chains (VL and CL) as well as the first heavy chain constant region (CH1) characteristic of conventional antibodies. Like the variable domain of conventional antibodies, the variable domain of these heavy chain homodimers (VHH) has three complementary determining regions (CDRs), sometimes referred to as CDR H1, CDR H2 and CDR H3. CDR H3 from the llama antibody can be up to three times longer than the comparable mouse CDR3. VHH sequences may include multiple framework (F) regions which flank the three CDR regions. VHH sequences include those that are naturally occurring as well as those identified using phage display, such as MA10, MG6 and MG7 (Emelie D. Rodrigues, *Single Domain Antibodies in Tissue Engineering*, University of Twente, Netherlands, 2014). A bone targeted VHH construct may be prepared to include at least one bone targeting sequence, such as Dn or En, where n=1 to 50. The bone targeting sequence can be positioned within a CDR sequence of the VHH and/or at one or both ends of the VHH sequence (FIG. 20, schematic). One, two, or all three CDRs or portions thereof, of the VHH may be replaced with a bone targeting sequence. The portions of the VHH fragment that do not include a CDR, e.g., the framework (F) regions, may function as a spacer region in the bone targeting moiety. Optionally, bone targeting sequences may be positioned within two or all three of the CDR sequences. As shown schematically in FIG. 20, F represents VHH framework regions, and the gray areas include CDRs H1, H2, and H3, and end segments, which may be used for positioning or spacing the bone targeting sequences.

Fc Regions

The polypeptides described herein may further include an Fc region. For example, a sALP can be a fusion polypeptide including an Fc region of an immunoglobulin, e.g., at the N-terminus or C-terminus of the polypeptide. An immunoglobulin molecule has a structure that is well known in the art. It includes two light chains (~23 kD each) and two heavy chains (~50-70 kD each) joined by inter-chain disulfide bonds. Immunoglobulins are readily cleaved proteolytically (e.g., by papain cleavage) into Fab (containing the light chain and the VH and CH1 domains of the heavy chain) and Fc (containing the CH2 and CH3 domains of the heavy chain, along with adjoining sequences). Useful Fc fragments as described herein include the Fc fragment of any immunoglobulin molecule, including IgG, IgM, IgA, IgD, or IgE, and their various subclasses (e.g., IgG1, IgG2, IgG3, IgG4, IgA1, IgA2), from any mammal (e.g., human). For instance, the Fc fragment may be human IgG1.

The Fc region may include all or a portion of an Fc fragment of an IgG. The IgG can be IgG1, IgG2, IgG3, or IgG4, or chimeras of two or more IgGs, such IgG2/4. IgG2/4 chimeras are described, e.g., in PCT Publication No. WO 2007/106585, which is hereby incorporated by reference. The Fc fragment may increase half-life and circulation time of the polypeptide following administration to a subject. For example, the half-life of the polypeptide may be from about 10 to about 100 hours (e.g., about 20, 30, 40, 50, 60, 70, 80, or 90 hours). The half-life can vary based on the mode of administration. The Fc fragments may include, for example, the CH2 and CH3 domains of the heavy chain and any portion of the hinge region. The Fc region can optionally be glycosylated at any appropriate one or more amino acid residues known to those skilled in the art. In particular, the Fc fragment of the fusion polypeptide has the amino acid sequence of SEQ ID NO: 253 or SEQ ID NO: 259, or has at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100%) sequence identity to SEQ ID NO: 253 or SEQ ID NO: 259. Engineered, e.g., non-naturally occurring, Fc regions can also be used (see, e.g., International Application Pub. No. WO2005/007809, which is hereby incorporated by reference). An Fc fragment as described herein can have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the Fc fragments described herein.

Linkers and Spacers

The polypeptides described herein may include one or more linkers or spacers of one or more amino acids. The polypeptides may also include one or more terminal residues located at the N- or C-terminus of the polypeptide. A linker or spacer may include a sequence of one or more (e.g., 2, 3, 4, 5, 6, 7, 8, 9 10, 20, 30, 40, 50, 60, 70, 80, 90, 100, 150, 200, 250, 300, 350, 400, 450, 500, or more) amino acids. A linker or spacer may be omitted from the polypeptides described herein.

Linkers can include any suitable amino acid to promote flexibility between adjacent domains or preclude steric interference between domains. Furthermore, linkers or spacers can be used to enhance protein folding, thermal stability, and/or recombinant expression of the polypeptide.

One or more additional amino acids can be positioned at the N-terminus, the C-terminus, and/or as intervening sequences between any or all of the components of the polypeptides described herein. For example, additional amino acids between an Fc region and the bone targeting moiety may be included. An exemplary intervening sequence includes one or more glycines or serines, such as GGGGS (SEQ ID NO: 254), which can be positioned between the Fc region and the bone targeting moiety sequence. Longer intervening sequences may be employed to provide additional flexibility in some embodiments.

In some embodiments, the linker includes the sequence of (GGGGA)$_2$GGGGS (SEQ ID NO: 255), (GGGGQ)$_2$ GGGGS (SEQ ID NO: 256), (GGGPS)$_2$GGGGS (SEQ ID NO: 257), or GGGGS(PGGGS)$_2$ (SEQ ID NO: 258). In some embodiments, the linker does not include the sequence of (GGGGA)$_2$GGGGS (SEQ ID NO: 255), (GGGGQ)$_2$ GGGGS (SEQ ID NO: 256), (GGGPS)$_2$GGGGS (SEQ ID NO: 257), or GGGGS(PGGGS)$_2$ (SEQ ID NO: 258).

Topology of the Polypeptides

The polypeptides described herein may include one or more of a sALP, a bone targeting moiety, an Fc region, a spacer, and a linker. The components of the polypeptides described herein may include any suitable topology arranged from the N-terminus to the C-terminus that provides proper function. A polypeptide that includes a bone targeting moiety may be referred to as a bone targeting conjugate, or a bone targeting Fc conjugate.

For example, a polypeptide that includes a sALP and an Fc region may have the structure N-sALP-Fc-C or N-Fc-sALP-C. Optionally, the polypeptide may further include a linker or spacer of one or more (e.g., 2, 3, 4, 5, 6, 7, 8, 9, 10, or more) amino acids between one or more of these domains.

A polypeptide may include a sALP and a bone targeting moiety (BTM) and have the structure N-sALP-BTM-C or N-BTM-sALP-C. Optionally, the polypeptide may further include a linker or spacer of one or more (e.g., 2, 3, 4, 5, 6, 7, 8, 9, 10, or more) amino acids between one or more of these domains.

A polypeptide may include a sALP, an Fc region, and a BTM. A polypeptide including all three components may have the structure N-sALP-Fc-BTM-C, N-Fc-BTM-sALP-C, N-BTM-sALP-Fc-C, N-sALP-BTM-Fc-C, N-Fc-sALP-BTM-C, or N-BTM-Fc-sALP-C. Optionally, the polypeptide may further include a linker or spacer of one or more (e.g., 2, 3, 4, 5, 6, 7, 8, 9, 10, or more) amino acids between one or more of these domains.

The polypeptide may include or consist of an amino acid sequence having at least 85% (e.g., 90%, 95%, 97%, 99%, or 100%) sequence identity to any one of SEQ ID NOs: 7-223, 247, and 262-264. For example, the polypeptide may include or consist of the sequence of any one of SEQ ID NOs: 72, 123, 155, or 177. The polypeptide may include or consist of an amino acid sequence having at least 85% (e.g., 90%, 95%, 97%, 99%, or 100%) sequence identity to SEQ ID NO: 123, in which, optionally, the polypeptide contains one or more of the following modifications: E108M, N213Q, and N286Q. The polypeptide may include or consists of SEQ ID NO: 123. The polypeptide may include or consist of an amino acid sequence having at least 85% (e.g., at least 90%, 95%, 97%, 99%, or 100%) sequence identity to SEQ ID NO: 177. The polypeptide may include or consist of SEQ ID NO: 177. The polypeptide may include or consist of an amino acid sequence having at least 85% (e.g., 90%, 95%, 97%, 99%, or 100%) sequence identity to SEQ ID NO: 260 or 261. The polypeptide may include or consist of the sequence of SEQ ID NO: 260. The polypeptide may include or consist of the sequence of SEQ ID NO: 261. The polypeptide may include a secretion signal peptide. The polypeptide may include or consist of an amino acid sequence having at least 85% (e.g., 90%, 95%, 97%, 99%, or 100%) sequence identity to SEQ ID NO: 263 or 264. The polypeptide may include or consist of the sequence of SEQ ID NO: 263. The polypeptide may include or consist of the sequence of SEQ ID NO: 264. The polypeptide may include any sALP catalytic domain, Fc IgG isotype (e.g., Fc of IgG2/4), or bone targeting moiety listed in Table 1, and topological permutations thereof. The polypeptide may include any single domain listed in Table 1.

TABLE 1

Exemplary sALP constructs

| Name | Mature Peptide Catalytic Domain Description | Fc IgG Isotype | Bone Targeting Moiety | Sequence Identifier |
|---|---|---|---|---|
| ALP001 | Human TNSALP (1-491) | IgG2/4 | D10 | SEQ ID NO: 7 |
| ALP002 | Human PALP (1-486) | IgG2/4 | D10 | SEQ ID NO: 8 |
| ALP003 | Human GALP (1-486) | IgG2/4 | D10 | SEQ ID NO: 9 |
| ALP004 | Human IALP (1-486) | IgG2/4 | D10 | SEQ ID NO: 10 |
| ALP009 | Macaca TNSALP | IgG2/4 | D10 | SEQ ID NO: 11 |
| ALP010 | Mouse TNSALP | IgG2/4 | D10 | SEQ ID NO: 12 |
| ALP011 | Human TNSALP (1-491) N213Q | IgG2/4 | D10 | SEQ ID NO: 13 |
| ALP012 | Human TNSALP (1-491) N286Q | IgG2/4 | D10 | SEQ ID NO: 14 |
| ALP013 | Human TNSALP (1-491) N413Q | IgG2/4 | D10 | SEQ ID NO: 15 |
| ALP014 | Human PALP (1-486) + SS | IgG2/4 | D10 | SEQ ID NO: 16 |
| ALP015 | Human PALP (1-486) + HP | IgG2/4 | D10 | SEQ ID NO: 17 |
| ALP016 | Human IALP (1-486) + SS | IgG2/4 | D10 | SEQ ID NO: 18 |
| ALP017 | Human IALP (1-486) + HP | IgG2/4 | D10 | SEQ ID NO: 19 |
| ALP018 | Human PALP (1-486) | IgG1 | D10 | SEQ ID NO: 20 |
| ALP019 | Human IALP (1-486) | IgG1 | D10 | SEQ ID NO: 21 |
| ALP021 | Human TNSALP + S | IgG2/4 | D10 | SEQ ID NO: 22 |
| ALP022 | Human TNSALP + SS | IgG2/4 | D10 | SEQ ID NO: 23 |
| ALP023 | Human TNSALP (1-491) N213Q, N286Q | IgG2/4 | D10 | SEQ ID NO: 24 |
| ALP024 | Human IALP (1-486) S429E | IgG2/4 | D10 | SEQ ID NO: 25 |
| ALP025 | Human IALP (1-486) W245R | IgG2/4 | D10 | SEQ ID NO: 26 |
| ALP026 | Human IALP (1-486) C481G | IgG2/4 | D10 | SEQ ID NO: 27 |
| ALP028 | Human TNSALP (1-491), N213Q, N286Q + S | IgG2/4 | D10 | SEQ ID NO: 28 |
| ALP029 | Human TNSALP (1-491), N213Q, N286Q + SS | IgG2/4 | D10 | SEQ ID NO: 29 |
| ALP030 | Human IALP (1-486) S429E, C481G | IgG2/4 | D10 | SEQ ID NO: 30 |
| ALP031 | Human IALP (1-486) W245R, S429E, C481G | IgG2/4 | D10 | SEQ ID NO: 31 |
| ALP032 | Human TNSALP (1-491) N123Q, N213Q, N286Q | IgG2/4 | D10 | SEQ ID NO: 32 |
| ALP033 | Human TNSALP (1-491) N213Q, N254Q, N286Q | IgG2/4 | D10 | SEQ ID NO: 33 |
| ALP034 | Human TNSALP (1-491) N213Q, N286Q, N564Q | IgG2/4 | D10 | SEQ ID NO: 34 |
| ALP035 | Human TNSALP (1-491) E108A, N213Q, N286Q | IgG2/4 | D10 | SEQ ID NO: 35 |
| ALP038 | Human TNSALP (1-491) N564Q | IgG2/4 | D10 | SEQ ID NO: 36 |
| ALP039 | Human TNSALP (1-491) E108A | IgG2/4 | D10 | SEQ ID NO: 37 |
| ALP042 | Human IALP (1-486) W245R, S428R, S429E, C481G | IgG2/4 | D10 | SEQ ID NO: 38 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP043 | Human IALP (1-486) W245R, S429H, C481G | IgG2/4 | D10 | SEQ ID NO: 39 |
| ALP044 | Human IALP (1-486) W245R, S428R, S429H, C481G | IgG2/4 | D10 | SEQ ID NO: 40 |
| ALP046 | Human IALP (1-486) W245R, S429E, C481G, N559Q | IgG2/4 | D10 | SEQ ID NO: 41 |
| ALP047 | Human IALP (1-486) W245R, N410Q, S429E, C481G | IgG2/4 | D10 | SEQ ID NO: 42 |
| ALP048 | Human IALP (1-486) W245R, N249Q, S429E, C481G | IgG2/4 | D10 | SEQ ID NO: 43 |
| ALP049 | Human IALP (1-486) N122Q, W245R, S429E, C481G | IgG2/4 | D10 | SEQ ID NO: 44 |
| ALP051 | Human IALP (1-486) N122Q, W245R, N410Q, S429E, C481G | IgG2/4 | D10 | SEQ ID NO: 45 |
| ALP052 | Human IALP (1-486) N122Q, W245R, S429E, C481G, N559Q | IgG2/4 | D10 | SEQ ID NO: 46 |
| ALP053 | Human IALP (1-486) W245R, N249Q, N410Q, S429E, C481G | IgG2/4 | D10 | SEQ ID NO: 47 |
| ALP054 | Human IALP (1-486) W245R, N249Q, S429E, C481G, N559Q | IgG2/4 | D10 | SEQ ID NO: 48 |
| ALP055 | Human IALP (1-486) W245R, N410Q, S429E, C481G, N559Q | IgG2/4 | D10 | SEQ ID NO: 49 |
| ALP056 | Human IALP (1-486) N122Q, W245R, S428R, S429E, C481G | IgG2/4 | D10 | SEQ ID NO: 50 |
| ALP057 | Human IALP (1-486) W245R, N249Q, S428R, S429E, C481G | IgG2/4 | D10 | SEQ ID NO: 51 |
| ALP058 | Human IALP (1-486) W245R, N410Q, S428R, S429E, C481G | IgG2/4 | D10 | SEQ ID NO: 52 |
| ALP059 | Human IALP (1-486) W245R, S428R, S429E, C481G, N559Q | IgG2/4 | D10 | SEQ ID NO: 53 |
| ALP060 | Human IALP (1-486) N122Q, W245R, S429H, C481G | IgG2/4 | D10 | SEQ ID NO: 54 |
| ALP061 | Human IALP (1-486) W245R, N249Q, S429H, C481G | IgG2/4 | D10 | SEQ ID NO: 55 |
| ALP062 | Human IALP (1-486) W245R, N410Q, S429H, C481G | IgG2/4 | D10 | SEQ ID NO: 56 |
| ALP063 | Human IALP (1-486) W245R, S429H, C481G, N559Q | IgG2/4 | D10 | SEQ ID NO: 57 |
| ALP089 | Human IALP (1-486) N122Q, W245R, N249Q, N410Q, S429E, C481G | IgG2/4 | D10 | SEQ ID NO: 58 |
| ALP090 | Human IALP (1-486) N122Q, W245R, N249Q, S429E, C481G, N559Q | IgG2/4 | D10 | SEQ ID NO: 59 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP091 | Human IALP (1-486) N122Q, W245R, N410Q, S429E, C481G, N559Q | IgG2/4 | D10 | SEQ ID NO: 60 |
| ALP092 | Human IALP (1-486) W245R, N249Q, N410Q, S429E, C481G, N559Q | IgG2/4 | D10 | SEQ ID NO: 61 |
| ALP093 | Human IALP (1-486) N122Q, W245R, N249Q, N410Q, S429E, C481G, N559Q | IgG2/4 | D10 | SEQ ID NO: 62 |
| ALP130 | Human TNSALP(1-491) E108R | IgG2/4 | D10 | SEQ ID NO: 63 |
| ALP131 | Human TNSALP(1-491) E108N | IgG2/4 | D10 | SEQ ID NO: 64 |
| ALP132 | Human TNSALP(1-491) E108D | IgG2/4 | D10 | SEQ ID NO: 65 |
| ALP133 | Human TNSALP(1--491) E108Q | IgG2/4 | D10 | SEQ ID NO: 66 |
| ALP134 | Human TNSALP(1-491) E108G | IgG2/4 | D10 | SEQ ID NO: 67 |
| ALP135 | Human TNSALP(1-491) E108H | IgG2/4 | D10 | SEQ ID NO: 68 |
| ALP136 | Human TNSALP(1--491) E108I | IgG2/4 | D10 | SEQ ID NO: 69 |
| ALP137 | Human TNSALP(1-491) E108L | IgG2/4 | D10 | SEQ ID NO: 70 |
| ALP138 | Human TNSALP(1-491) E108K | IgG2/4 | D10 | SEQ ID NO: 71 |
| ALP139 | Human TNSALP(1--491) E108M | IgG2/4 | D10 | SEQ ID NO: 72 |
| ALP140 | Human TNSALP(1--491) E108F | IgG2/4 | D10 | SEQ ID NO: 73 |
| ALP141 | Human TNSALP(1-491) E108P | IgG2/4 | D10 | SEQ ID NO: 74 |
| ALP142 | Human TNSALP(1-491) E108S | IgG2/4 | D10 | SEQ ID NO: 75 |
| ALP143 | Human TNSALP(1--491) E108T | IgG2/4 | D10 | SEQ ID NO: 76 |
| ALP144 | Human TNSALP (1-491) E108W | IgG2/4 | D10 | SEQ ID NO: 77 |
| ALP145 | Human TNSALP (1-491) E108Y | IgG2/4 | D10 | SEQ ID NO: 78 |
| ALP146 | Human TNSALP (1-491) E108V | IgG2/4 | D10 | SEQ ID NO: 79 |
| ALP147 | Human TNSALP (1-491) M384A | IgG2/4 | D10 | SEQ ID NO: 80 |
| ALP148 | Human TNSALP (1-491) M384R | IgG2/4 | D10 | SEQ ID NO: 81 |
| ALP149 | Human TNSALP (1-491) M384N | IgG2/4 | D10 | SEQ ID NO: 82 |
| ALP150 | Human TNSALP (1-491) M384D | IgG2/4 | D10 | SEQ ID NO: 83 |
| ALP151 | Human TNSALP (1-491) M384Q | IgG2/4 | D10 | SEQ ID NO: 84 |
| ALP152 | Human TNSALP (1-491) M384E | IgG2/4 | D10 | SEQ ID NO: 85 |
| ALP153 | Human TNSALP (1-491) M384G | IgG2/4 | D10 | SEQ ID NO: 86 |
| ALP154 | Human TNSALP (1-491) M384H | IgG2/4 | D10 | SEQ ID NO: 87 |
| ALP155 | Human TNSALP (1-491) M384I | IgG2/4 | D10 | SEQ ID NO: 88 |
| ALP156 | Human TNSALP (1-491) M384L | IgG2/4 | D10 | SEQ ID NO: 89 |
| ALP157 | Human TNSALP (1-491) M384K | IgG2/4 | D10 | SEQ ID NO: 90 |
| ALP158 | Human TNSALP (1-491) M384F | IgG2/4 | D10 | SEQ ID NO: 91 |
| ALP159 | Human TNSALP (1-491) M384S | IgG2/4 | D10 | SEQ ID NO: 92 |
| ALP160 | Human TNSALP (1-491) M384T | IgG2/4 | D10 | SEQ ID NO: 93 |
| ALP161 | Human TNSALP (1-491) M384Y | IgG2/4 | D10 | SEQ ID NO: 94 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP162 | Human TNSALP (1-491) M384V | IgG2/4 | D10 | SEQ ID NO: 95 |
| ALP163 | Human TNSALP (1-491) L385V | IgG2/4 | D10 | SEQ ID NO: 96 |
| ALP164 | Human TNSALP (1-491) L385K | IgG2/4 | D10 | SEQ ID NO: 97 |
| ALP165 | Human TNSALP (1-491) L385A | IgG2/4 | D10 | SEQ ID NO: 98 |
| ALP166 | Human TNSALP (1-491) L385N | IgG2/4 | D10 | SEQ ID NO: 99 |
| ALP167 | Human TNSALP (1-491) L385H | IgG2/4 | D10 | SEQ ID NO: 100 |
| ALP168 | Human TNSALP (1-491) L385Q | IgG2/4 | D10 | SEQ ID NO: 101 |
| ALP169 | Human TNSALP (1-491) L385S | IgG2/4 | D10 | SEQ ID NO: 102 |
| ALP170 | Human TNSALP (1-491) L385T | IgG2/4 | D10 | SEQ ID NO: 103 |
| ALP171 | Human IALP (1-486) W245R, S428A, S429H, C481G | IgG2/4 | D10 | SEQ ID NO: 104 |
| ALP172 | Human IALP (1-486) W245R, S428N, S429H, C481G | IgG2/4 | D10 | SEQ ID NO: 105 |
| ALP173 | Human IALP (1-486) W245R, S428D, S429H, C481G | IgG2/4 | D10 | SEQ ID NO: 106 |
| ALP174 | Human IALP (1-486) W245R, S428Q, S429H, C481G | IgG2/4 | D10 | SEQ ID NO: 107 |
| ALP175 | Human IALP (1-486) W245R, S428G, S429H, C481G | IgG2/4 | D10 | SEQ ID NO: 108 |
| ALP176 | Human IALP (1-486) W245R, S428H, S429H, C481G | IgG2/4 | D10 | SEQ ID NO: 109 |
| ALP177 | Human IALP (1-486) W245R, S428I, S429H, C481G | IgG2/4 | D10 | SEQ ID NO: 110 |
| ALP178 | Human IALP (1-486) W245R, S428L, S429H, C481G | IgG2/4 | D10 | SEQ ID NO: 111 |
| ALP179 | Human IALP (1-486) W245R, S428K, S429H, C481G | IgG2/4 | D10 | SEQ ID NO: 112 |
| ALP180 | Human IALP (1-486) W245R, S428M, S429H, C481G | IgG2/4 | D10 | SEQ ID NO: 113 |
| ALP181 | Human IALP (1-486) W245R, S428F, S429H, C481G | IgG2/4 | D10 | SEQ ID NO: 114 |
| ALP182 | Human IALP (1-486) W245R, S428T, S429H, C481G | IgG2/4 | D10 | SEQ ID NO: 115 |
| ALP183 | Human IALP (1-486) W245R, S428Y, S429H, C481G | IgG2/4 | D10 | SEQ ID NO: 116 |
| ALP184 | Human IALP (1-486) W245R, S428V, S429H, C481G | IgG2/4 | D10 | SEQ ID NO: 117 |
| ALP185 | Human IALP (1-486) W245R, S428D, S429E, C481G | IgG2/4 | D10 | SEQ ID NO: 118 |
| ALP186 | Human IALP (1-486) W245R, S428E, S429E, C481G | IgG2/4 | D10 | SEQ ID NO: 119 |
| ALP187 | Human IALP (1-486) W245R, S428T, S429E, C481G | IgG2/4 | D10 | SEQ ID NO: 120 |
| ALP188 | Human IALP (1-486) W245R, S428V, S429E, C481G | IgG2/4 | D10 | SEQ ID NO: 121 |
| ALP200 | Human TNSALP (1-491) E108Q, N213Q, N286Q | IgG2/4 | D10 | SEQ ID NO: 122 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP201 | Human TNSALP (1-491) E108M, N213Q, N286Q | IgG2/4 | D10 | SEQ ID NO: 123 |
| ALP202 | Human TNSALP (1-491) E108L, N213Q, N286Q | IgG2/4 | D10 | SEQ ID NO: 124 |
| ALP203 | Human TNSALP (1-491) E108K, N213Q, N286Q | IgG2/4 | D10 | SEQ ID NO: 125 |
| ALP204 | Human TNSALP (1-491) E108S, N213Q, N286Q | IgG2/4 | D10 | SEQ ID NO: 126 |
| ALP205 | Human TNSALP (1-491) E108T, N213Q, N286Q | IgG2/4 | D10 | SEQ ID NO: 127 |
| ALP206 | Human IALP (1-486) W245R, N410Q, S429H, C481G | IgG2/4 | D10 | SEQ ID NO: 128 |
| ALP207 | Human IALP (1-486) W245R, N249Q, S429H, C481G | IgG2/4 | D10 | SEQ ID NO: 129 |
| ALP208 | Human IALP (1-486) N122Q, W245R, S429H, C481G | IgG2/4 | D10 | SEQ ID NO: 130 |
| ALP209 | Human IALP (1-486) N122Q, W245R, N249Q, S429H, C481G | IgG2/4 | D10 | SEQ ID NO: 131 |
| ALP210 | Human IALP (1-486) N122Q, W245R, N410Q, S429H, C481G | IgG2/4 | D10 | SEQ ID NO: 132 |
| ALP211 | Human IALP (1-486) W245R, N249Q, S429H, C481G, N559Q | IgG2/4 | D10 | SEQ ID NO: 133 |
| ALP212 | Human IALP (1-486) N122Q, W245R, N249Q, N410Q, S429H, C481G | IgG2/4 | D10 | SEQ ID NO: 134 |
| ALP213 | Human IALP (1-486) W245R, N410Q, S428D, S429H, C481G | IgG2/4 | D10 | SEQ ID NO: 135 |
| ALP214 | Human IALP (1-486) W245R, N249Q, S428D, S429H, C481G | IgG2/4 | D10 | SEQ ID NO: 136 |
| ALP215 | Human IALP (1-486) N122Q, W245R, S428D, S429H, C481G | IgG2/4 | D10 | SEQ ID NO: 137 |
| ALP216 | Human IALP (1-486) N122Q, W245R, N249Q, S428D, S429H, C481G | IgG2/4 | D10 | SEQ ID NO: 138 |
| ALP217 | Human IALP (1-486) N122Q, W245R, N410Q, S428D, S429H, C481G | IgG2/4 | D10 | SEQ ID NO: 139 |
| ALP218 | Human IALP (1-486) W245R, N249Q, S428D, 5429H, C481G, N559Q | IgG2/4 | D10 | SEQ ID NO: 140 |
| ALP219 | Human IALP (1-486) N122Q, W245R, N249Q, N410Q, S428D, S429H, C481G | IgG2/4 | D10 | SEQ ID NO: 141 |
| ALP220 | Human IALP (1-486) W245R, N410Q, S428Q, S429H, C481G | IgG2/4 | D10 | SEQ ID NO:142 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP221 | Human IALP (1-486) W245R, N249Q, S428Q S429H, C481G | IgG2/4 | D10 | SEQ ID NO: 143 |
| ALP222 | Human IALP (1-486) N122Q, W245R, S428Q, S429H, C481G | IgG2/4 | D10 | SEQ ID NO: 144 |
| ALP223 | Human IALP (1-486) N122Q, W245R, N249Q, S428Q, S429H, C481G | IgG2/4 | D10 | SEQ ID NO: 145 |
| ALP224 | Human IALP (1-486) N122Q, W245R, N410Q, S428Q, S429H, C481G | IgG2/4 | D10 | SEQ ID NO: 146 |
| ALP225 | Human IALP (1-486) W245R, N249Q, S428Q, S429H, C481G, N559Q | IgG2/4 | D10 | SEQ ID NO: 147 |
| ALP226 | Human IALP (1-486) N122Q, W245R, N249Q, N410Q, 5428Q, S429H, C481G | IgG2/4 | D10 | SEQ ID NO: 148 |
| ALP229 | Human TNSALP (1-491) E108M, N213Q, N286Q | IgG2,4 | D1 | SEQ ID NO: 149 |
| ALP230 | Human TNSALP (1-491) E108M, N213Q, N286Q | IgG2,4 | D2 | SEQ ID NO: 150 |
| ALP231 | Human TNSALP (1-491) E108M, N213Q, N286Q | IgG2,4 | D3 | SEQ ID NO: 151 |
| ALP232 | Human TNSALP (1-491) E108M, N213Q, N286Q | IgG2,4 | D4 | SEQ ID NO: 152 |
| ALP233 | Human TNSALP (1-491) E108M, N213Q, N286Q | IgG2,4 | D5 | SEQ ID NO: 153 |
| ALP234 | Human TNSALP (1-491) E108M, N213Q, N286Q | IgG2,4 | D6 | SEQ ID NO: 154 |
| ALP235 | Human TNSALP (1-491) E108M, N213Q, N286Q | IgG2,4 | D7 | SEQ ID NO: 155 |
| ALP236 | Human TNSALP (1-491) E108M, N213Q, N286Q | IgG2,4 | D8 | SEQ ID NO: 156 |
| ALP237 | Human TNSALP (1-491) E108M, N213Q, N286Q | IgG2,4 | D9 | SEQ ID NO: 157 |
| ALP238 | Human TNSALP (1-491) E108M, N213Q, N286Q | IgG2,4 | E1 | SEQ ID NO: 158 |
| ALP239 | Human TNSALP (1-491) E108M, N213Q, N286Q | IgG2,4 | E5 | SEQ ID NO: 159 |
| ALP240 | Human TNSALP (1-491) E108M, N213Q, N286Q | IgG2,4 | E10 | SEQ ID NO: 160 |
| ALP241 | Human TNSALP (1-491) E108M, N213Q, N286Q | IgG2,4 | E15 | SEQ ID NO: 161 |
| ALP242 | Human TNSALP (1-491) E108M, N213Q, N286Q | IgG2,4 | E20 | SEQ ID NO: 162 |
| ALP243 | Human TNSALP (1-491) E108M, N213Q, N286Q | IgG2,4 | DDS | SEQ ID NO: 163 |
| ALP244 | Human TNSALP (1-491) E108M, N213Q, N286Q | IgG2,4 | DDSDDS | SEQ ID NO: 164 |
| ALP245 | Human TNSALP (1-491) E108M, N213Q, N286Q | IgG2,4 | DDSDDSDDS | SEQ ID NO: 165 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP246 | Human TNSALP (1-491) E108M, N213Q, N286Q | IgG2,4 | EES | SEQ ID NO: 166 |
| ALP247 | Human TNSALP (1-491) E108M, N213Q, N286Q | IgG2,4 | EESEES | SEQ ID NO: 167 |
| ALP248 | Human TNSALP (1-491) E108M, N213Q, N286Q | IgG2,4 | EESEESEES | SEQ ID NO: 168 |
| ALP249 | Human TNSALP (1-491) E108M, N213Q, N286Q | IgG2,4 | DAD | SEQ ID NO: 169 |
| ALP250 | Human TNSALP (1-491) E108M, N213Q, N286Q | IgG2,4 | DADDAD | SEQ ID NO: 170 |
| ALP251 | Human TNSALP (1-491) E108M, N213Q, N286Q | IgG2,4 | DADDADDAD | SEQ ID NO: 171 |
| ALP257 | TNSALP (1-491) E108M, N213Q, N286Q | IgG2/4 | D9 | SEQ ID NO: 175 |
| ALP258 | TNSALP (1-491) E108M, N213Q, N286Q | IgG2/4 | D8 | SEQ ID NO: 176 |
| ALP259 | TNSALP (1-491) E108M, N213Q, N286Q | IgG2/4 | D7 | SEQ ID NO: 177 |
| ALP104 | Human TNSALP (1-491) N213Q, N286Q | IgG2/4 | N-terminal DSSEEKFLRRIGRFGGGGGS | SEQ ID NO: 178 |
| ALP105 | Human TNSALP (1-491) N213Q, N286Q | IgG2/4 | C-terminal GGGGSDDDEEKFLRRIGRFG | SEQ ID NO: 179 |
| ALP106 | Human TNSALP (1-491) N213Q, N286Q | IgG2/4 | N-terminal DDDEEKFLRRIGRFGGGGGS | SEQ ID NO: 180 |
| ALP107 | Human TNSALP (1-491) N213Q, N286Q | IgG2/4 | C-terminal GGGGSDDDDDDDDKFLRRIGRFG | SEQ ID NO: 181 |
| ALP108 | Human TNSALP (1-491) N213Q, N286Q | IgG2/4 | N-terminal DDDDDDDDKFLRRIGRFGGGGGS | SEQ ID NO: 182 |
| ALP109 | Human TNSALP (1-491) N213Q, N286Q | IgG2/4 | C-terminal GGGGSDDDDDDDDDDKFLRRIGRFG | SEQ ID NO: 183 |
| ALP110 | Human TNSALP (1-491) N213Q, N286Q | IgG2/4 | N-terminal DDDDDDDDDDKFLRRIGRFGGGGS | SEQ ID NO: 184 |
| ALP111 | Human TNSALP (1-491) N213Q, N286Q | IgG2/4 | C-terminal GGGGSEEEEEEEEKFLRRIGRFG | SEQ ID NO: 185 |
| ALP112 | Human TNSALP (1-491) N213Q, N286Q | IgG2/4 | N-terminal EEEEEEEEKFLRRIGRFGGGGS | SEQ ID NO: 186 |
| ALP113 | Human TNSALP (1-491) N213Q, N286Q | IgG2/4 | C-terminal GGGGSDDDEEEEKFLRRIGRFG | SEQ ID NO: 187 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP114 | Human TNSALP (1-491) N213Q, N286Q | IgG2/4 | N-terminal DDDEEEEKFLR RIGRFGGGGG S | SEQ ID NO: 188 |
| ALP115 | Human TNSALP (1-491) N213Q, N286Q | IgG2/4 | C-terminal GGGGSDDDEE KFFRRFGRFG | SEQ ID NO: 189 |
| ALP116 | Human TNSALP (1-491) N213Q, N286Q | IgG2/4 | N-terminal DDDEEKFFRRF GRFGGGGGS | SEQ ID NO: 190 |
| ALP117 | Human TNSALP (1-491) N213Q, N286Q | IgG2/4 | C-terminal GGGGSDDDEE KFLRRIRRFDG RFG | SEQ ID NO: 191 |
| ALP118 | Human TNSALP (1-491) N213Q, N286Q | IgG2/4 | N-terminal DDDEEKFLRRI RRFDGRFGGG GGS | SEQ ID NO: 192 |
| ALP119 | Human TNSALP (1-491) N213Q, N286Q | IgG2/4 | C-terminal GGGGSDDDEE KFLRRLRRFDG RYG | SEQ ID NO: 193 |
| ALP120 | Human TNSALP (1-491) N213Q, N286Q | IgG2/4 | N-terminal DDDEEKFLRRL RRFDGRYGGG GGS | SEQ ID NO: 194 |
| ALP121 | Human TNSALP (1-491) N213Q, N286Q | IgG2/4 | C-terminal GGGGSDDDEE KFLRRLRRFDE GRYG | SEQ ID NO: 195 |
| ALP122 | Human TNSALP (1-491) N213Q, N286Q | IgG2/4 | N-terminal DDDEEKFLRRL RRFDEGRYGG GGGS | SEQ ID NO: 196 |
| ALP123 | Human TNSALP (1-491) N213Q, N286Q | IgG2/4 | C-terminal GGGGSKSDGG YYYTQSDY | SEQ ID NO: 197 |
| ALP124 | Human TNSALP (1-491) N213Q, N286Q | IgG2/4 | N-terminal KSDGGYYYTQ SDYGGGGS | SEQ ID NO: 198 |
| ALP125 | Human TNSALP (1-491) N213Q, N286Q | IgG2/4 | C-terminal GGGGSTRYSY STTPEEYDL | SEQ ID NO: 199 |
| ALP126 | Human TNSALP (1-491) N213Q, N286Q | IgG2/4 | N-terminal TRYSYSTTPEE YDLGGGGS | SEQ ID NO: 200 |
| ALP127 | Human TNSALP (1-491) N213Q, N286Q | IgG2/4 | C-terminal GGGGSTGGSS PFGGVAGVKD Y | SEQ ID NO: 201 |
| ALP128 | Human TNSALP (1-491) N213Q, N286Q | IgG2/4 | N-terminal TGGSSPFGGV AGVKDYGGGG S | SEQ ID NO: 202 |
| ALP067 | Human TNSALP (1-491) N213Q, N286Q | IgG2/4 | GGGGSVTKHL NQISQSY | SEQ ID NO: 203 |
| ALP068 | Human TNSALP (1-491) N213Q, N286Q | IgG2/4 | VTKHLNQISQS Y | SEQ ID NO: 204 |

TABLE 1-continued

Exemplary sALP constructs

| Name | Mature Peptide Catalytic Domain Description | Fc IgG Isotype | Bone Targeting Moiety | Sequence Identifier |
|---|---|---|---|---|
| ALP069 | Human TNSALP (1-491) N213Q, N286Q | IgG2/4 | GGGGSKPRSVSG | SEQ ID NO: 205 |
| ALP070 | Human TNSALP (1-491) N213Q, N286Q | IgG2/4 | KPRSVSG | SEQ ID NO: 206 |
| ALP071 | Human TNSALP (1-491) N213Q, N286Q | IgG2/4 | GGGGSNPYHPTIPQSVH | SEQ ID NO: 207 |
| ALP072 | Human TNSALP (1-491) N213Q, N286Q | IgG2/4 | NPYHPTIPQSVH | SEQ ID NO: 208 |
| ALP073 | Human TNSALP (1-491) N213Q, N286Q | IgG2/4 | GGGGSSVSVGMKPSPRP | SEQ ID NO: 209 |
| ALP074 | Human TNSALP (1-491) N213Q, N286Q | IgG2/4 | SVSVGMKPSPRP | SEQ ID NO: 210 |
| ALP075 | Human TNSALP (1-491) N213Q, N286Q | IgG2/4 | GGGGS | SEQ ID NO: 211 |
| ALP076 | Human TNSALP (1-491) N213Q, N286Q | IgG2/4 | none | SEQ ID NO: 212 |
| ALP077 | Human IALP (1-486) W245R, S429E, C481G | IgG2/4 | GGGGSVTKHLNQISQSY | SEQ ID NO: 213 |
| ALP078 | Human IALP (1-486) W245R, S429E, C481G | IgG2/4 | VTKHLNQISQSY | SEQ ID NO: 214 |
| ALP079 | Human IALP (1-486) W245R, S429E, C481G | IgG2/4 | GGGGSKPRSVSG | SEQ ID NO: 215 |
| ALP080 | Human IALP (1-486) W245R, S429E, C481G | IgG2/4 | KPRSVSG | SEQ ID NO: 216 |
| ALP081 | Human IALP (1-486) W245R, S429E, C481G | IgG2/4 | GGGGSNPYHPTIPQSVH | SEQ ID NO: 217 |
| ALP082 | Human IALP (1-486) W245R, S429E, C481G | IgG2/4 | NPYHPTIPQSVH | SEQ ID NO: 218 |
| ALP083 | Human IALP (1-486) W245R, S429E, C481G | IgG2/4 | GGGGSSVSVGMKPSPRP | SEQ ID NO: 219 |
| ALP084 | Human IALP (1-486) W245R, S429E, C481G | IgG2/4 | SVSVGMKPSPRP | SEQ ID NO: 220 |
| ALP085 | Human IALP (1-486) W245R, S429E, C481G | IgG2/4 | GGGGS | SEQ ID NO: 221 |
| ALP086 | Human IALP (1-486) W245R, S429E, C481G | IgG2/4 | none | SEQ ID NO: 222 |
| ALP088 | Human IALP (1-486) W245R, S429E, C481G | IgG2/4 | GGGGSDDDDDDDDDD | SEQ ID NO: 223 |
| ALP050 | Human IALP (1-486) N122Q, W245R, N249Q, S429E, C481G | IgG2/4 | D10 | SEQ ID NO: 247 |
| ALP112 delG | Human TNSALP (1-491) N213Q, N286Q, delG | IgG2/4 | N-terminal EEEEEEEEKFLRRIGRFGGGGS | SEQ ID NO: 262 |
| ALP201 sec | Human TNSALP (1-491) E108M, N213Q, N286Q, with secretion signal peptide | IgG2/4 | D10 | SEQ ID NO: 263 |
| ALP259 sec | Human TNSALP (1-491) E108M, N213Q, N286Q, with secretion signal peptide | IgG2/4 | D7 | SEQ ID NO: 264 |

Tunable Binding to Bone Tissue

Figure 14:
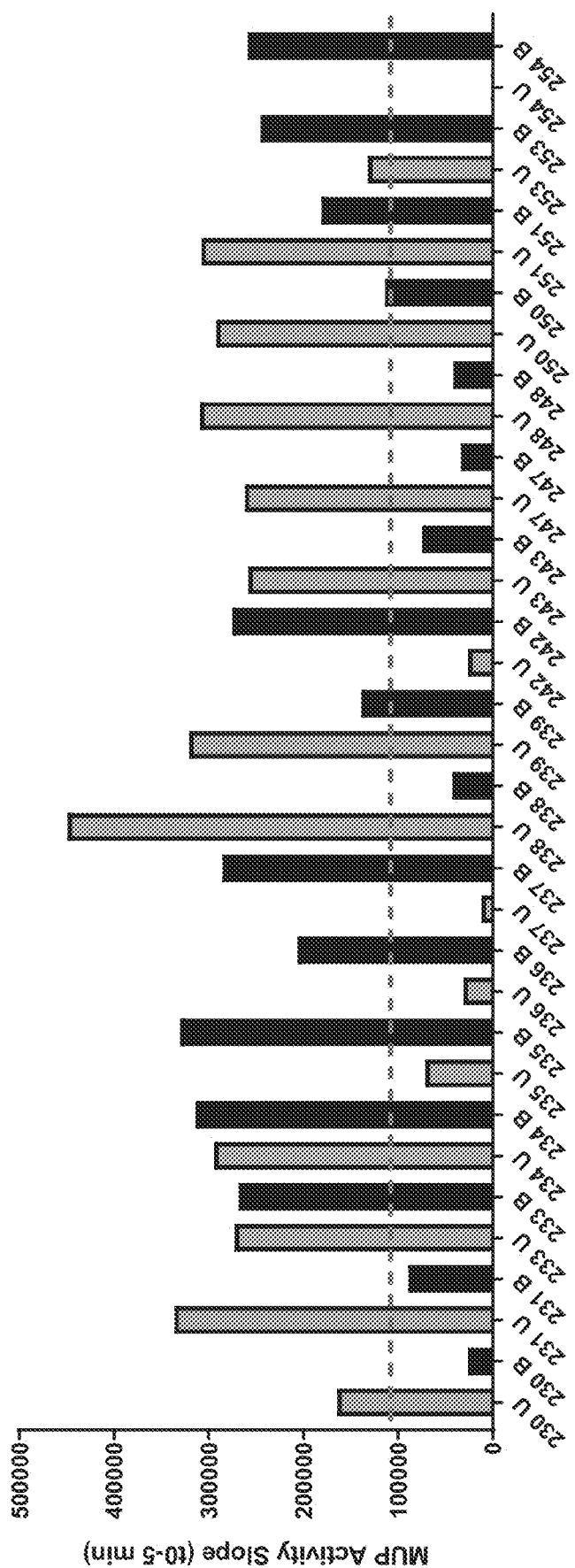
FIG. 14 is a graph showing binding activity in supernatants, comparing bound and unbound fractions, for various tagged constructs (ALP230-ALP239, ALP242, ALP243, ALP247, ALP248, ALP250, ALP2521, ALP253, AND ALP254. A dashed line indicates baseline bone binding as control. Constructs with either a $D_5$ or $D_6$ bone targeting moiety showed nearly equal bound (B) and unbound (U) components.

Bone targeting conjugates described herein can exhibit variable binding to bone tissue. For example, bone targeted conjugates can exhibit differences in association with bone (binding) and/or dissociation behavior. Bone targeting Fc conjugates that include polyD and polyE targeting sequences, for example, exhibit high binding affinity to bone tissue, whereas certain bone targeting Fc conjugates that employ a statherin-derived or a VHH sequence as a targeting sequence may exhibit intermediate binding affinity to bone tissue (see, e.g., FIGS. 1 and 14).

Bone targeting conjugates may exhibit differences in dissociation behavior even if their binding affinities are similar. For example, a bone targeting Fc conjugate such as ALP-Fc-$D_{10}$ (SEQ ID NO: 31) bound to bone tissue may not readily exchange with unbound conjugate in solution, whereas a single domain bone targeted VHH construct that contains polyD or polyE sequences within one or more of its CDRs (e.g., SEQ ID NOs: 249 and 250) may exhibit more mobility to bind and dissociate from bone tissue in the presence of unbound conjugate (see, e.g., FIGS. 10A-10B).

The bone targeting conjugates described herein can be tuned to meet particular therapeutic needs by selecting targeting sequences and other components so as to alter binding affinity, dissociate rates, residence time and mobility. For example, an active equilibrium binding to the target could ensure that the polypeptide does not block active sites on bone as the strongest binding molecules would. In particular, constructs that bind too strongly to bone would dissociate more slowly. Because catalytic activity of the ALP is dependent upon zinc and magnesium ions, the ALP can be inactivated over time by loss of these ions. If inactive ALP constructs remain bound to bone, they prevent recruitment of active ALP. Conversely, rapid dissociation of active ALP from bone reduces efficacy by preventing the ALP from maximizing its enzymatic activity. Therefore, a balance of binding is desired. Selections can be made among the options described for the targeting sequence (e.g., poly D, poly E, phage display derived sequences, full or partial statherin sequences, full or partial VHH sequences, or combinations thereof) as well as the different topological options (e.g., bone targeting moiety at the N-terminus or C-terminus of the conjugate). This ensures favorable binding kinetics to establish bone binding residence times that increase efficacy and decrease long-term binding of inactive enzyme. Bone binding residence times can exhibit a range of from about 1 second to about 1 month (e.g., 2 second, 3 seconds, 4 seconds, 5 seconds, 6 seconds 7 seconds, 8 seconds, 9 seconds, 10 seconds, 20 seconds, 30 seconds, 40 seconds, 50 seconds, 1 minutes, 2 minutes, 2 minutes, 4 minutes, 5 minutes, 6 minutes, 7 minutes, 8 minutes, 9 minutes, 10 minutes, 20 minutes, 30 minutes, 40 minutes, 50 minutes, 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 1 week, 2 weeks, 3 weeks, 1 month).

Methods for Testing the sALP Constructs

The polypeptides described herein (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) may be tested using one or more assays described in more detail below to test for catalytic activity, bone targeting ability, and PK profile.

Hydroxyapatite Binding Assay

Synthetic HA may be used to probe HA binding by the polypeptides described herein. In separate centrifuge tubes, bone targeting polypeptides may be diluted, e.g., in bovine serum albumin (BSA) in phosphate buffered saline (PBS) pH 7.4 (1 mL suspension per tube). To each polypeptide-containing tube, 1 mg synthetic HA may be added, and tubes may be incubated at room temperature for 2 hours with orbital mixing to prevent HA from settling. After incubation, samples may be centrifuged at 16,000 rcf for 5 minutes to separate the solid HA-bound fraction from the unbound protein suspension. HA-bound fractions can be subsequently washed, e.g., three times with PBS, and the final HA fraction was suspended in 100 μL PBS. Suspended HA-bound fractions and 100 μL unbound protein suspensions are transferred to 96-well black plates (1 fraction per well), and relative protein concentrations can be determined by fluorescent excitation/emission at 488 nm/585 nm using a fluorescent plate reader (Spectramax i3x).

Bone Homogenate Assay

Femurs from male C57BL/6 mice may be stored at −80° C. prior to use. Femurs can be transferred to 2 mL centrifuge tubes (2 femurs per tube) with 1 mL 0.2% (w/w) collagenase type 2 (Worthington) in BS with 1×EDTA-free serine and cysteine proteases inhibitor cocktail (COMPLETE™, Roche). Femurs can be briefly vortexed and incubated at 37° C. with shaking (800 rpm) for 1 hour. Remaining connective tissue can be removed, and femurs can be placed on petri dishes on ice. Bone marrow can be flushed with PBS using needle and syringe. Dry bone is massed (typically 30-50 mg per femur) and placed in pre-chilled hard tissue grinding individual disposable beat beaters (PRECELLYS®, Bertin Instruments) with 0.75 mL PBS with 1×protease inhibitor. Femurs can be homogenized using a high-throughput bead mill homogenizer (Bullet Blender, 4° C., max speed, 4 cycles of 30 second duration). Homogenate can be transferred to 1.5 mL centrifuge tubes and centrifuged at 12,000×g for 15 minutes at 4° C. to separate bone homogenate from released protein/cell debris. Other methods of isolation of bone homogenate may be used, including slicing and other grinding mechanisms. Bone homogenate may then be resuspended in 0.1% BSA in PBS for use in binding assays.

Bone targeting polypeptides can be diluted to 50 nM in PBS with 0.1% BSA and incubated with 3 mg bone homogenate in individual 1.5 mL centrifuge tubes (1 mL per tube). Samples can be mixed at room temperature for 2 hours before bone homogenate bound and unbound fractions were separated via centrifugation. Bone homogenate fractions can be washed 3 times with PBS, and final homogenate pellet may be suspended in 100 μL PBS. Suspended bone homogenate and 100 μL unbound protein suspensions can be quantified for relative fluorescent Fc-fusion concentration using a fluorescent plate reader.

Determination of Relative Protein Affinity for Bone Homogenate In Vitro

A multi-dose assay can be developed to rank the relative affinity of bone binding proteins. For proteins that efficiently bound bone homogenate, relative dissociation rates were determined by this kinetic protein-on-bone exchange assay. Proteins can be assessed individually (e.g., one protein type per tube), by incubating saturating concentrations (1 μM) of unlabeled bone binding protein with 5 mg bone homogenate in 1.5 mL Eppendorf tubes. After 24 hr incubations with unlabeled protein, bone homogenate can be centrifuged (16,000 rcf, 5 minutes) to remove excess unbound protein. Bone homogenate, saturated with a given bone binding protein, can be resuspended in 0.5 μM solutions of the same bone binding protein labeled with an ALEXA FLUOR® fluorescent probe and allowed to incubate for 1, 2, 4, 8, and 24 hours before bone homogenate was centrifuged, washed 3× with PBS, and transferred to a 96-well black plate. The supernatant from the first centrifugation can also be collected to quantify the amount of fluorescent protein that remained in suspension (unbound). A fluorescent plate reader may be used to quantify the amount of bound and unbound fluorescently-labeled protein at each time point, which allows for a kinetic representation of the unlabeled protein dissociation rate.

Metabolic Assay for ALP Activity (MUP)

Protein samples (supernatant, partially purified, or column purified samples) may be assayed for ALP activity in solution using 4-methylumbelliferyl phosphate (4-MUP) as an artificial substrate. Hydrolysis of the phosphoester bond in 4-MUP releases the fluorescent compound 4-methylumbelliferone, which is easily detected by a fluorimeter. Product quantitation may be performed using a 4-methylumbelliferone (4-MU) standard curve measured on the same plate, with standard concentrations at 0, 1.25 uM, 2.5 uM, 5 uM, 10 uM, and 20 uM. A 10 mM stock solution of 4-MU can be prepared in ethanol and diluted into assay buffer [50 mM HEPES pH 7.4, 150 mM NaCl, 1 mM MgCl2, 1 mg/mL bovine serum albumin]. Purified fusion protein samples can be prepared as 0.1 mg/mL solutions in assay buffer, and serially diluted to an appropriate final concentration (e.g., 1 nM) for assay in assay buffer. 4-MUP stock solutions were prepared in assay buffer. All solutions may be brought to 37° C. prior to initiation of the assay by addition of 4-MUP to the protein sample at a final concentration of 10 uM. Production of 4-MU may be measured at an excitation wavelength of 360 nm and an emission wavelength of 465 nm. Data may be collected in a plate reader held at 37° C., every 40 seconds for a total of 20 minutes. Rates of reaction were calculated by linear regression in units of activity, where 1 U=1 micromole 4-MUP hydrolyzed/minute. Specific activities can be calculated in Units/mg of protein assayed.

Plate Bone Assay

Bone homogenate fractions can be assayed for ALP activity. The bone homogenate fractions can be suspended in 100 μL PBS and transferred to 96-well black plates. 100 μL unbound protein suspensions can also be transferred to separate wells of the 96-well plate. To each well, 100 μL of ALP detection solution (10 μM 4-MUP, 1% BSA) can be added and kinetic fluorescent reading (at 360/465) immediately initiated and run for 20 minutes, with fluorescent intensity emissions collected every 30 seconds. The slope of fluorescence intensity vs. time may represent ALP concentration in each sample fraction.

MUP activity of the bound and unbound fractions of the tested constructs may be measured via the initial activity slope in the first 5 minutes to preserve linearity. The ratio of MUP activity may be determined for each fusion protein, as ratio=(activity bound)/(activity unbound).

Protein activity in serum assay Serum samples can be diluted 100-fold to 6,000-fold into assay buffer (50 mM HEPES, 150 mM NaCl, 1 mM MgCl$_2$, pH 7.4 and 1 mg/mL BSA) to determine pK. The diluted samples can be quantitated, and the standard curve can be generated based upon from asfotase alfa of known activity and concentration. The slope of fluorescence intensity vs. time may represent the rate of 4-MU production, which corresponded to ALP activity, in each sample fraction as a function of units/mL serum.

In Vivo Fluorescent Imaging in Mice

Semi-quantitative biodistribution studies can be performed in nude mice using ALEXA FLUOR® 750 labeled bone targeting proteins and protein fragments (e.g., VHH). Bone targeting ALP-Fc fusion proteins and bone targeting VHHs can be fluorescently labeled with ALEXA FLUOR® 750 using Invitrogen SAIVI kit (covalent conjugation via activated succinimidyl esters), and purified in a gel exclusion resin to remove unconjugated fluorophore. Purified proteins (suspended in PBS) can be injected into nude mice via tail vein at doses of ~3 mg/kg.

Female J:NU outbred mice (Jackson Laboratories, Bar Harbor, ME) may receive 3 mg/kg of test article via volume-normalized 100 μL intravenous tail vein injection. For in vivo image acquisition, subjects can be maintained under 2-3% isoflurane anesthesia on the imaging platform (IVIS Spectrum Imaging System, PerkinElmer Inc., Waltham, MA). Automatic exposure settings with field of view (FOV) C, F/Stop 2, medium binning and 800 nm emission/750 nm excitation filters were used for both 2D epi-illumination and 3D trans-illumination acquisitions. Ex vivo tissue specimen 2D epi-illumination fluorescent imaging can be acquired under identical conditions less for the exception that all specimens for each tissue type can be simultaneously acquired in a single image. All animal studies are conducted according to provisions of the Animal Welfare Act and the principles of the Guide for the Care and Use of Laboratory Animals.

Fluorescent imaging analysis can be performed using manufacturer supplied 2D/3D software (Living Image 4.5.1, Perkin Elmer). Regions of interest (ROIs) of uniform area applied across each set of subjects were manually positioned to account for differences in subject positioning. Longitudinal in vivo image color scale ranges can be normalized across all subjects and timepoints; ex vivo specimen color scales may be individually determined to best represent the fluorescent signal for each tissue set.

Pyrophosphate Hydrolysis Assay

The polypeptides described herein may be assayed for activity against the natural substrate pyrophosphate. Pyrophosphate hydrolysis can be measured by detection of the product, phosphate anion, using PiBlue assay reagent (Bio-Assay Systems) which turns bright green upon binding of phosphate. Quantitation of phosphate levels in each well can be performed using a standard curve of phosphate solutions made in assay buffer that may be read on the assay plate. Sodium pyrophosphate decahydrate (Sigma Chemicals) stock solutions can be prepared in pure water at a concentration of 10 mM. Purified fusion protein samples were prepared as 0.1 mg/mL solutions in assay buffer [50 mM HEPES pH 7.4, 150 mM NaCl, 1 mM MgCl2, 1 mg/mL bovine serum albumin], and serially diluted to an appropriate final concentration for assay in assay buffer. Pyrophosphate samples for assay may be prepared by dilution of the stock solution in assay buffer. All solutions were brought to 37° C. prior to initiation of the reaction. Protein solutions were added to clear 96-well plates, and the plates were placed in a Jitterbug plate shaker held at 37° C. Initiation of the reaction may be performed by addition of the pyrophosphate solutions to the protein solution. Typically, the pyrophosphate hydrolysis reaction may be performed at pyrophosphate concentrations of 0 uM, 1.56 uM, 3.12 uM, 6.25 uM, 12.5 uM, 25 uM, 50 uM, 100 uM, 200 uM, and 400 uM simultaneously in the same plate. Eight reaction wells were set up at each pyrophosphate concentration, and the reaction can be stopped by addition of PiBlue reagent (added at an equal volume as the final reaction volume) after 0, 1, 2, 3, 4, 5, 6, and 7 minutes had elapsed after addition of pyrophosphate to the plate. Addition of PiBlue reagent stops any further reaction by lowering the pH of the detection reagent and inactivating the enzyme. Color can be allowed to develop in the plate for 30 minutes prior to being read for absorbance at 620 nm. Rates of reaction at each pyrophosphate concentration may be calculated by constructing progress curves from the individual time points. Rates of reaction at each concentration may be used to calculate Km and Vmax values in GraphPad prism, using a Michaelis-Menten enzyme kinetic fit. kcat values were calculated by: Vmax/(moles protein assayed)=kcat.

Pyridoxyl-5'-phosphate Hydrolysis Assay.

A second natural substrate of alkaline phosphatase is pyridoxyl-5'phosphate (PLP). A polypeptide can be assayed for activity against PLP in a coupled assay format, in which pyridoxyl, the product of PLP hydrolysis, is converted to the fluorescent pyridoxolactone, by $M.\ loti$ tetrametric pyridoxyl dehydrogenase (tPLDH, SEQ ID NO: 246). The gene for 6×His-tagged tPLDH can be synthesized by standard methods and cloned into a bacterial expression plasmid under control of the T7 promoter. 6×His-tagged tPLDH was expressed in BL21(DE3) cells using standard protocols and purified by standard affinity chromatography methods. The protein can be concentrated to a concentration of 1900 uM using centrifugation concentration, i.e., Amicon Ultra15 Spin concentrator, and frozen at −80° C. until used in the assay. Purified fusion protein samples can be prepared as 0.1 mg/mL solutions in assay buffer [50 mM HEPES pH 7.4, 150 mM NaCl, 1 mM $MgCl_2$, 1 mg/mL bovine serum albumin]. Final serially diluted samples can be placed in a black 96-well plate, along with pyridoxolactone standards (made in assay buffer). To the protein samples, $NAD^+$, tPLDH, and PLP solutions (made in assay buffer) can be added in order to final concentrations of 3 mM NAD+, 4 uM tPLDH, and 3 uM PLP and mixed. All solutions are brought to 37° C. prior to initiation of the reaction, and the reaction plate can be incubated at 37° C., and fluorescence detected by excitation at 355 nm and emission measured at 445 nm. Amount of pyridoxolactone product generated can be calculated using a standard curve generated from measured fluorescence from the pyridoxolactone wells in the plate. Rates of reaction can be calculated by linear regression of the progress curves in units of pmoles pyridoxyl produced/min. Specific activities can be calculated by dividing rates of reaction by the protein concentration used in the assay reaction.

Pharmacokinetic Analysis in a Murine Model

Male C57BL/6 mice (Jackson Labs) between 11-12 weeks of age can be dosed with a single injection at 4-7 mg/kg, either into tail vein or subcutaneously, with sample proteins at 1 mg/mL in sterile PBS (without calcium or magnesium), and followed for 14-21 days. Two intermediate blood draws and one terminal blood draw (cardiac puncture, $CO_2$ anesthesia) can be performed on each mouse and staggered in the cohort (4 mice in each of 4 groups, per molecule and per administration type). Blood samples (100 μL, yielding 50 μL plasma after centrifugation) can be collected into Li/heparinized tubes at 0.25, 1, 6, 24, 48, 72, 96, 120, 192, 264, 336, and 480 hours. Blood samples can be stored at 4° C. until processed into plasma. Plasma samples can be snap frozen in liquid N2 and stored at −80° C. and further quantitated.

In Vivo Murine HPP Models

Efficacy can be measured in an in vivo murine HPP model. In this prophylactic study, treatment can be initiated at birth and continued for 35 days. A polypeptide or vehicle (PBS) can be administered subcutaneously to Akp2GW$^{-/-}$ mice into the scapular region. The efficacy endpoints can be evaluated at the end of treatment were the survival, bone mineralization defects, and growth (body weight). Body weight can also be evaluated on a daily basis as an indicator of the general well-being of animals. Age- and litter-matched PBS-treated VVT mice can serve as reference controls. Animals may receive daily subcutaneous injection of polypeptide until day 24. On day 25, the daily subcutaneous dose of the polypeptide may be reduced by half-log of the initial dose and maintained until last treatment dose on day 35.

Pharmaceutical Compositions, Formulations, and Dosing

A polypeptide described herein that includes a sALP or sALP fusion polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated as a pharmaceutical composition by a variety of methods known in the art. As will be appreciated by the skilled artisan, the route and/or mode of administration may be used to dictate the formulation. The route of administration can depend on a variety of factors, such as the environment and therapeutic goals. In particular, the polypeptides and fusion polypeptides described herein can be formulation for administration by any route known in the art, e.g., subcutaneous (e.g., by subcutaneous injection), intravenously, orally, nasally, intramuscularly, sublingually, intrathecally, or intradermally. By way of example, pharmaceutical compositions can be in the form of a liquid, solution, suspension, pill, capsule, tablet, gelcap, powder, gel, ointment, cream, nebulae, mist, atomized vapor, aerosol, or phytosome.

Formulations

The compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated according to standard methods. Pharmaceutical formulation is a well-established art, and is further described in, e.g., *Remington: The Science and Practice of Pharmacy,* 22nd Ed., Allen, Ed. 2012; Ansel et al. (1999) "Pharmaceutical Dosage Forms and Drug Delivery Systems," 7th Edition, Lippincott Williams & Wilkins Publishers (ISBN: 0683305727); and Kibbe (2000) "Handbook of Pharmaceutical Excipients American Pharmaceutical Association," 3rd Edition (ISBN: 091733096X). For instance, a sALP composition (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated, for example, as a buffered solution at a suitable concentration and suitable for storage at 2-8° C. (e.g., 4° C.). A composition can also be formulated for storage at a temperature below 0° C. (e.g., −20° C. or −80° C.). A composition can further be formulated for storage for up to 2 years (e.g., one month, two months, three months, four months, five months, six months, seven months, eight months, nine months, 10 months, 11 months, 1 year, 1½ years, or 2 years) at 2-8° C. (e.g., 4° C.). Thus, the compositions described herein can be stable in storage for at least 1 year at 2-8° C. (e.g., 4° C.). A composition can be formulated in a suitable volume, e.g., a volume of about 0.1 mL to about 10 mL.

The compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be in a variety of forms. These forms include, e.g., liquid, semi-solid and solid dosage forms, such as liquid solutions (e.g., injectable and infusible solutions), dispersions or suspensions, tablets, pills, powders, liposomes and suppositories. The preferred form depends, in part, on the intended mode of administration and therapeutic application.

For example, compositions intended for systemic or local delivery can be in the form of injectable or infusible solutions. Accordingly, the compositions (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated for administration by a parenteral mode (e.g., subcutaneous, intravenous, intraperitoneal, or intramuscular injection). "Parenteral administration," "administered parenterally," and other grammatically equivalent phrases, as used herein, refer to modes of administration other than enteral and topical administration, usually by injection, and include, without limitation, subcutaneous, intradermal, intravenous, intranasal, intraocular, pulmonary, intramuscular, intra-arterial, intrathecal, intracapsular, intraorbital, intracardiac, intradermal, intrapulmonary, intraperitoneal, transtracheal, subcuticular, intraarticular, subcapsular, subarachnoid, intraspinal, epidural, intracerebral, intracranial, intracarotid, and intrasternal injection and infusion. Particular routes of administration include intravenous and subcutaneous administration.

The compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated as a solution, microemulsion, dispersion, liposome, or other ordered structure suitable for stable storage at high concentration. Sterile injectable solutions can be prepared by incorporating a composition described herein in the required amount in an appropriate solvent with one or a combination of ingredients enumerated above, as required, followed by filter sterilization. Generally, dispersions are prepared by incorporating a composition described herein into a sterile vehicle that contains a basic dispersion medium and the required other ingredients from those enumerated above. In the case of sterile powders for the preparation of sterile injectable solutions, methods for preparation include vacuum drying and freeze-drying that yield a powder of a composition described herein plus any additional desired ingredient (see below) from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition a reagent that delays absorption, for example, monostearate salts, and gelatin.

The compositions described herein can also be formulated in immunoliposome compositions. Such formulations can be prepared by methods known in the art such as, e.g., the methods described in Epstein et al. (1985) *Proc Natl Acad Sci USA* 82:3688; Hwang et al. (1980) *Proc Natl Acad Sci USA* 77:4030; and U.S. Pat. Nos. 4,485,045 and 4,544,545. Liposomes with enhanced circulation time are disclosed in, e.g., U.S. Pat. No. 5,013,556.

Compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can also be formulated with a carrier that will protect the composition (e.g., a sALP polypeptide or sALP fusion polypeptide) against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are known in the art. See, e.g., J. R. Robinson (1978) "Sustained and Controlled Release Drug Delivery Systems," Marcel Dekker, Inc., New York.

A composition containing a sALP or sALP fusion polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated as a solution for injection, which is a clear, colorless to slightly yellow, aqueous solution, pH 7.4. The sALP or sALP polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) may be formulated at a concentration of 12 mg/0.3 mL, 18 mg/0.45 mL, 28 mg/0.7 mL, 40 mg/1 ml, or 80 mg/0.8 mL. The sALP or sALP polypeptide (e.g., formulated at a concentration of 12 mg/0.3 mL, 18 mg/0.45 mL, 28 mg/0.7 mL, 40 mg/1 ml, or 80 mg/0.8 mL) may be formulated with a carrier, such as sodium chloride and/or sodium phosphate (e.g., ~150 mM NaCl and/or ~25 mM sodium phosphate, in particular at a pH of ~7.4). In particular, the composition can be formulated as a 40 mg/ml solution for injection, in which each ml of solution contains 40 mg of sALP or sALP polypeptide (e.g., each vial contains 0.3 ml solution and 12 mg of sALP (40 mg/ml), each vial contains 0.45 ml solution and 18 mg of sALP (40 mg/ml), each vial contains 0.7 ml solution and 28 mg of sALP (40 mg/ml), or each vial contains 1.0 ml solution and 40 mg of sALP or sALP polypeptide (40 mg/ml)). A sALP or sALP polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated as a solution for injection at a concentration of 100 mg/ml, in which each 1 ml of solution contains 100 mg of sALP or sALP polypeptide (e.g., each vial contains 0.8 ml solution and 80 mg of asfotase alfa (100 mg/ml)). The sALP may be formulated such that about 0.1 mg to about 500 mg are present in a volume of about 0.01 mL to about 10 mL.

When compositions are to be used in combination with a second active agent, the compositions can be co-formulated with the second agent, or the compositions can be formulated separately from the second agent formulation. For example, the respective pharmaceutical compositions can be mixed, e.g., just prior to administration, and administered together or can be administered separately, e.g., at the same time or at different times.

Compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be formulated for administration to a subject or, if administered to a fetus, to a female carrying such fetus, along with intravenous gamma globulin therapy (IVIG), plasmapheresis, plasma replacement, or plasma exchange.

Carriers/Vehicles

Preparations containing a sALP or sALP fusion polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be provided to a subject having or being prone to a bone mineralization disorder, such as HPP, in combination with pharmaceutically acceptable sterile aqueous or non-aqueous solvents, suspensions or emulsions. Examples of non-aqueous solvents are propylene glycol, polyethylene glycol, vegetable oil, fish oil, and injectable organic esters. Aqueous carriers include water, water-alcohol solutions, emulsions or suspensions, including saline and buffered medical parenteral vehicles including sodium chloride solution, Ringer's dextrose solution, dextrose plus sodium chloride solution, Ringer's solution containing lactose, or fixed oils. For example, the pharmaceutically acceptable carrier can include sodium chloride and/or sodium phosphate, in which the composition includes, e.g., about 150 mM sodium chloride and/or about 25 mM sodium phosphate, pH 7.4.

Intravenous vehicles can include fluid and nutrient replenishers, electrolyte replenishers, such as those based upon Ringer's dextrose, and the like. Pharmaceutically acceptable salts can be included therein, for example, mineral acid salts such as hydrochlorides, hydrobromides, phosphates, sulfates, and the like; and the salts of organic acids such as acetates, propionates, malonates, benzoates, and the like. Additionally, auxiliary substances, such as wetting or emulsifying agents, pH buffering substances, and the like, can be present in such vehicles. A thorough discussion of pharmaceutically acceptable carriers is available in *Remington: The Science and Practice of Pharmacy,* 22nd Ed., Allen, Ed. 2012.

Dosage

The sALP polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) described herein can be administered to a subject having or being prone to a bone mineralization disorder, such as HPP, in individual doses ranging, e.g., from 0.01 mg/kg to 500 mg/kg (e.g., from 0.05 mg/kg to 500 mg/kg, from 0.1 mg/kg to 60 mg/kg, from 0.1 mg/kg to 50 mg/kg, from 0.1 mg/kg to 20 mg/kg, from 5 mg/kg to 500 mg/kg, from 0.1 mg/kg to 100 mg/kg, from 10 mg/kg to 100 mg/kg, from 0.1 mg/kg to 50 mg/kg, 0.5 mg/kg to 25 mg/kg, 1.0 mg/kg to 10 mg/kg, 1.5 mg/kg to 5 mg/kg, or 2.0 mg/kg to 3.0 mg/kg) or from 1 µg/kg to 1,000 µg/kg (e.g., from 5 µg/kg to 1,000 µg/kg, from 1 µg/kg to 750 µg/kg, from 5 µg/kg to 750 µg/kg, from 10 µg/kg to 750 µg/kg, from 1 µg/kg to 500 µg/kg, from 5 µg/kg to 500 µg/kg, from 10 µg/kg to 500 µg/kg, from 1 µg/kg to 100 µg/kg, from 5 µg/kg to 100 µg/kg, from 10 µg/kg to 100 µg/kg, from 1 µg/kg to 50 µg/kg, from 5 µg/kg to 50 µg/kg, or from 10 µg/kg to 50 µg/kg).

Exemplary doses of a sALP include, e.g., 0.01, 0.05, 0.1, 0.5, 1, 2, 2.5, 5, 10, 20, 25, 50, 100, 125, 150, 200, 250, or 500 mg/kg; or 1, 2, 2.5, 5, 10, 20, 25, 50, 100, 125, 150, 200, 250, 500, 750, 900, or 1,000 µg/kg. For all dosages or ranges recited herein, the term "about" can be used to modify these dosages by ±10% of the recited values or range endpoints. In particular, compositions (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) in accordance with the present disclosure can be administered to a subject in doses ranging from about 0.001 mg/kg/day to about 500 mg/kg/day, about 0.01 mg/kg/day to about 100 mg/kg/day, or about 0.01 mg/kg/day to about 20 mg/kg/day. For example, the sALP compositions (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be administered to a subject in a weekly dosage ranging, e.g., from about 0.5 mg/kg/week to about 140 mg/kg/week, e.g., about 0.8 mg/kg/week to about 50 mg/kg/week, or about 1 mg/kg/week to about 10 mg/kg/week (e.g., about 6 or about 9 mg/kg/week). In particular, the sALP can be administered one or more times per week (e.g., 1, 2, 3, 4, 5, 6, 7, or more times per week), one or more times every other week, or one or more times per month (e.g., once every 14 days, 15 days 16 days, 17 days, 18 days, 19 days, 20 days, 21 days, 22 days, 23 days, 24 days, 25 days, 26 days, 27 days, 28 days, 29 days, or 30 days).

In particular, the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be administered at a dosage of 2 mg/kg three times a week (total dose 6 mg/kg/week), 1 mg/kg six times a week (total dose 6 mg/kg/week), 3 mg/kg three times a week (total dose 9 mg/kg/week), 0.5 mg/kg three times a week (total dose of 1.5 mg/kg/week), or 9.3 mg/kg three times a week (total dose 28 mg/kg/week). The dosage may be adapted by the clinician in accordance with conventional factors such as the extent of the disease and different parameters from the subject having or being prone to a bone mineralization disorder, such as HPP. Alternatively, 0.1 mg/kg to 9 mg/kg can be administered one time per week.

Dosages of compositions including sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be provided in either a single or multiple dosage regimens. Doses can be administered, e.g., hourly, bi-hourly, daily, bi-daily, twice a week, three times a week, four times a week, five times a week, six times a week, weekly, biweekly, monthly, bimonthly, or yearly. Alternatively, doses can be administered, e.g., twice, three times, four times, five times, six times, seven times, eight times, nine times, ten times, eleven times, or twelve times per day, week, or month. In particular, the dosing regimen is once weekly. The duration of the dosing regimen can be, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 day(s), week(s), or month(s), or even for the remaining lifespan of the subject having or being prone to a bone mineralization disorder, such as HPP. The amount, frequency, and duration of dosage will be adapted by the clinician in accordance with conventional factors such as the extent of the disease and different parameters from the subject having or being prone to a bone mineralization disorder, such as HPP.

For example, the dosage of a sALP or sALP fusion polypeptide (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) may be from about 0.1 mg/kg of body weight to about 10 mg/kg of body weight administered subcutaneously or intravenously one or more (e.g., 2, 3, 4, 5, 6, or 7) times per week.

Production of Nucleic Acids and Polypeptides

The polynucleotides encoding sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be produced by any method known in the art. The polynucleotide may encode an amino acid sequence having at least 85% (e.g., 90%, 95%, 97%, 99%, or 100%) sequence identity to any one of SEQ ID NOs: 7-223, 247, and 262-264 (e.g., any one of SEQ ID NOs: 72, 123, 155, or 177). The polynucleotide may have at least 85% (e.g., 90%, 95%, 97%, 99%, or 100%) sequence identity to any one of SEQ ID NOs: 265-268. The polynucleotide may include or consist of any one of SEQ ID NOs: 265-268. The polynucleotide may include or consist of SEQ ID NO: 265. The polynucleotide may include or consist of SEQ ID NO: 266. The polynucleotide may include or consist of SEQ ID NO: 267. The polynucleotide may include or consist of SEQ ID NO: 268.

Typically, a polynucleotide encoding the desired fusion polypeptide is generated using molecular cloning methods, and is generally placed within a vector, such as a plasmid or virus. The vector is used to transform the polynucleotide into a host cell appropriate for the expression of the fusion polypeptide. Representative methods are disclosed, for example, in Maniatis et al. (Cold Springs Harbor Laboratory, 1989). Many cell types can be used as appropriate host cells, although mammalian cells are preferable because they are able to confer appropriate post-translational modifications (e.g., glycosylation or sialylation). Host cells of the present disclosure can include, e.g., Chinese Hamster Ovary (CHO) cell, L cell, C127 cell, 3T3 cell, BHK cell, COS-7 cell or any other suitable host cell known in the art. For example, the host cell is a Chinese Hamster Ovary (CHO) cell (e.g., a CHO-DG44 cell) or an HEK293 cell.

The sALPs and sALP fusion polypeptides (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be produced under any conditions suitable to effect expression of the sALP polypeptide in the host cell. Such conditions include appropriate selection of a media prepared with components such as a buffer, bicarbonate and/or HEPES, ions like chloride, phosphate, calcium, sodium, potassium, magnesium, iron, carbon sources like simple sugars, amino acids, potentially lipids, nucleotides, vitamins and growth factors like insulin; regular commercially available media like alpha-MEM, DMEM, Ham's-F12, and IMDM supplemented with 2-4 mM L-glutamine and 5% Fetal bovine serum; regular commercially available animal protein free media like HYCLONE™ SFM4CHO, Sigma CHO DHFR⁻, Cambrex POWER™ CHO CD supplemented with 2-4 mM L-glutamine. These media are desirably prepared without thymidine, hypoxanthine and L-glycine to maintain selective pressure, allowing stable protein-product expression.

Large scale methods for manufacturing bulk protein are described, for example, in PCT Publication Nos. WO 2017/031114 and WO 2017/214130, the disclosures of which are hereby incorporated by reference in their entirety.

Methods of Treatment

Provided herein are methods for treating or ameliorating at least one symptom of a subject with a bone mineralization disorder, such as HPP. Other diseases or disorders, such as bone fracture, osteoporosis, sclerosteosis, chondrocalcinosis, hypotonia, Duchenne's muscular dystrophy, tracheobronchomalacia, seizure, neurofibromatosis 1 (NF-1), and craniosynostosis may also be treated by the compositions and methods described herein. The subject may have muscle weakness. The subject may have a muscle weakness disease, such as calcium pyrophosphate deposition (CPPD) or familial hypophosphatemia. Such treatment may include administering an alkaline phosphatase, or a polypeptide having alkaline phosphatase activity, to decrease the elevated PPi concentration in such subject. For example, a soluble alkaline phosphatase (sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) may be administered to neonates, children, adolescents, or adults.

Subjects may be diagnosed with a bone mineralization disorder (e.g., HPP) prior to administration of an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). Additionally, a subject having or being prone to a bone mineralization disorder, such as HPP, can be a naïve subject that has not been previously treated with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein).

The method includes administering an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) to a subject having or being prone to a bone mineralization disorder, such as HPP, in a single or multiple dosages over a period of time. In particular, a sALP, such as a polypeptide having the sequence of any one of SEQ ID NOs: 7-223, 247, and 262-264, can be administered to a subject previously determined to have elevated inorganic pyrophosphate (PPi) concentration or at least one predetermined biomarker/score for an HPP symptom (e.g., muscle weakness), such as an average BOT-2 strength score of less than 10, an average BOT-2 running speed and agility score of less than 5, an average CHAQ index score greater than about 0.8, and/or an average PODCI score of less than about 40, an average 6MWT of less than about 80% of the predicted 6MWT value, a Muscle Strength Grade of less than 5, and/or an average HHD value (e.g., an average HHD muscle or grip strength value) of, e.g., less than about 80% of the predicted HHD value. For example, a sALP can be administered to a subject previously determined to have a concentration of PPi in a sample (e.g., a plasma sample) of greater than about 5.71 µM for an infant or child (e.g., a subject less than about 12 years of age); greater than about 4.78 µM for an adolescent (e.g., a subject of about 13 to about 18 years of age); or greater than about 5.82 µM for an adult (e.g., a subject of greater than about 18 years of age). In other embodiments, the bone mineralization disorder, such as HPP, described herein is caused by an elevated concentration of at least one alkaline phosphatase substrate (e.g., PPi, PLP, PEA, etc.). Alternatively, an alkaline phosphatase, or a polypeptide having alkaline phosphatase activity, (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be administered to a subject having or being prone to a bone mineralization disorder, such as HPP, prior to determination of muscle weakness score (e.g., using the BOT-2 strength score, BOT-2 running speed and agility score, the CHAQ index score, the BSID-III scaled score, the PDMS-2 standard score, a Muscle Strength score, a 6MWT value, and/or a HHD value). Treatment with an ALP according to the methods described herein promotes, e.g., an increase in activities of ADL, a decrease in pain, and/or an improvement in motor development.

Additionally, each of the described scores (e.g., the BOT-2 strength score, BOT-2 running speed and agility score, the CHAQ index score, the BSID-III scaled score, the PDMS-2 standard score, 6MWT, the 12-POMA-G, a modified performance-oriented mobility assessment (mPOMA-G, such as the one illustrated in Phillips et al. 2015 Bone Abstracts 4:P136), or the HHD value) of a subject having or being prone to a bone mineralization disorder, such as HPP, described herein can be used singly or in any combination to assess treatment efficacy using a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the sALP is effective for treating the bone mineralization disorder, such as HPP.

For example, when administration of an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) to a subject having or being prone to a bone mineralization disorder, such as HPP, results in an average increase in the BOT-2 strength score to about 10 or greater than about 10, in which the subject previously had an average BOT-2 strength score of less than about 10, then the alkaline phosphatase or a polypeptide having alkaline phosphatase activity treatment is effective at treating, e.g., physical impairments associated with a bone mineralization disorder, such as HPP. Alternatively, when administration of a sALP does not result in an average increase in the BOT-2 strength score to about 10 or greater than about 10, the dosage and/or frequency of alkaline phosphatase or a polypeptide having alkaline phosphatase activity administration can be changed in order to determine the effective amount of the alkaline phosphatase or a polypeptide having alkaline phosphatase activity for the subject. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Additionally, when administration of an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) to a subject having or being prone to a bone mineralization disorder, such as HPP, results in an improvement in the Muscle Strength Grade categorization of the subject of one or more (e.g., an improvement to a Muscle Strength Grade of 1, 2, 3, 4, or 5 from a prior, lower Muscle Strength Grade), in which the subject previously had an average Muscle Strength Grade of less than about 5, then the alkaline phosphatase or a polypeptide having alkaline phosphatase activity treatment is effective at treating, e.g., physical impairments associated with a bone mineralization disorder, such as HPP. Alternatively, when administration of a sALP does not result in an improvement in the Muscle Strength Grade categorization of the subject of one or more from a prior, lower Muscle Strength Grade, the dosage and/or frequency of alkaline phosphatase or a polypeptide having alkaline phosphatase activity administration can be changed (e.g., increased) in order to determine the effective amount of the alkaline phosphatase or a polypeptide having alkaline phosphatase activity for the subject. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Biomarkers/Endpoints for Diagnosis and/or Treatment

A bone mineralization (such as HPP including, e.g., perinatal HPP, infantile HPP, childhood HPP, and odonto-hypophosphatasia, an HPP-like disease, CPPD, and familial hypophosphatemia, as described herein) can be treated with an alkaline phosphatase, or a polypeptide having alkaline phosphatase activity, (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). The methods described herein are also useful for diagnosing a subject having or being prone to a bone mineralization disorder, such as HPP, identifying a subject as having or being prone to a bone mineralization disorder, such as HPP, or testing the efficacy of treatment of a bone mineralization disorder, such as HPP. For example, a subject may be diagnosed as having or being prone to a bone mineralization disorder, such as HPP, if the subject is characterized as having certain characteristic biomarkers or metric scores. A subject may be treated with an alkaline phosphatase, or a polypeptide having alkaline phosphatase activity, (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), and the treatment efficacy or effects may be analyzed using the characteristic biomarkers or metric scores. Such biomarkers may include, e.g., the elevated inorganic pyrophosphate (PPi) concentration and/or the decreased alkaline phosphatase (ALP) in the serum, the bone or muscle tissues, or the urine of the subject. Exemplary metrics useful in the methods described herein for determining muscle weakness treatment efficacy may include: (1) the Bruininks-Oseretsky Test of Motor Proficiency $2^{nd}$ Edition (BOT-2), (2) the Childhood Health Assessment Questionnaire (CHAQ), (3) the Pediatric Outcomes Data Collection Instrument (PODCI), (4) Bayley Scales of Infant and Toddler Development, $3^{rd}$ Edition (BSID-III), (5) the Peabody Developmental Motor Scales, 2nd Edition (PDMS-2), (6) the Six Minute Walk Test (6MWT), (7) the Muscle Strength Grade, and (8) Handheld Dynamometry (HHD), which are described in further detail below.

Bone Healing and Mineralization

A subject having or being prone to a bone mineralization disorder, such as HPP, can be identified for treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) based on a level of bone mineralization. For example, bone mineralization may be used as a metric to diagnose a patient as having a bone mineralization disorder, such as HPP, or testing the efficacy of a polypeptide described herein. In a subject with a bone mineralization disorder (e.g., HPP) administration of the sALP results in an increase in bone healing in the subject following successful treatment.

A decrease in bone healing results in loss of bone and includes decreased mineralization that results in the disunion of two or more bones. Bone healing and decreased mineralization may be compared to a reference bone. Methods for identifying a decrease in bone healing and mineralization are routine and include non-invasive techniques such as radiography and computed tomography (CT). Typically, images of the relevant area of the subject can be taken before and at one or more time points following the sALP treatment, and the images can be compared to assess treatment efficacy. Decreased bone healing and/or mineralization can be identified as decreased opacity. Images can be taken at any time during sALP treatment, and can be timed to be, e.g., 1, 2, 3, 4, 5, or 6 day(s), week(s), or month(s), or year(s) following initiation of the sALP ERT treatment or when a decrease in efficacy is suspected. The decrease in bone healing and/or mineralization in the subject may become detectable at least 1, 2, 3, 4, 5, 6, 7, 8, 9, 10, 11, or 12 week(s) or month(s) following initiation of the sALP treatment period. The decrease in bone healing and/or mineralization in the subject may in some cases be sustained for at least 1, 2, 3, 4, 5, 6, 7, 8, 9, 10, 11, or 12 week(s), month(s), or year(s) following initiation of the sALP ERT treatment period. An increase in bone healing and mineralization may be used to determine that the sALP efficacy is restored and the bone mineralization disorder (e.g., HPP) is being efficaciously treated following therapy.

Bone Mineral Density (BMD)

A subject having or being prone to a bone mineralization disorder, such as HPP, can be identified for treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) based on a BMD level. A reduction in BMD (e.g., relative to a normal subject) may be used as a metric to diagnose a patient as having a bone mineralization disorder, such as HPP.

A decrease in BMD can be used to monitor the efficacy of the sALP (e.g., the polypeptide of any one of SEQ ID NOs: 7-223, 247, and 262-264) during the ERT. Methods for measuring BMD are known in the art and include, for instance, bone biopsy, dual-energy X-ray absorptiometry (DXA or DEXA), peripheral quantitative CT (pQCT), high-resolution pQCT (HR-pQCT), and quantitative ultrasound (QUS). Measurements can be made by any routine method, including CT Hounsfield measurement, and can use comparison of results to a normative database or control subject. BMD is sometimes reported as a Z-score or a T-score. Pre-treatment BMD values can be measured at any time during sALP ERT treatment, and can be timed to be 1, 2, 3, 4, 5, 6, 7, 8, 9, 10, 11, or 12 day(s), week(s), month(s), or year(s) following initiation of sALP ERT. The BMD value of a reference point after treatment may decrease by, e.g., 0.01%, 0.05%, 0.1%, 0.5%, or 1%. The decrease in a BMD value of a reference point after initiation of sALP treatment may also be unchanged or a change is undetectable. An increase in BMD may be used to determine that the sALP efficacy is restored and the bone mineralization disorder (e.g., HPP) is being efficaciously treated following therapy.

Plasma Inorganic Pyrophosphate (PPi) and Alkaline Phosphatase (ALP) Concentrations A subject having or being prone to a bone mineralization disorder, such as HPP, can be identified for treatment with an alkaline phosphatase or a polypeptide having alkaline phosphatase activity, (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) by determining the inorganic pyrophosphate (PPi) and/or alkaline phosphatase (ALP) concentrations in a sample, such as a plasma or urine sample, from the subject. Any method known to those of skill in the art can be used to quantify the PPi and/or ALP concentrations in a plasma sample or alternatively in a urine sample, as described in detail in Whyte et al., 1995 (J. Clin. Invest. 95(4): 1440-1445), hereby incorporated by reference in its entirety. Methods to quantify PPi concentrations in a plasma or urine sample are also described in Cheung et al., 1977 (Anal. Biochem. 83: 61-63), Cook et al., 1978 (Anal. Biochem. 91: 557-565), and Johnson et al, 1968 (Anal. Biochem. 26: 137-145), which are each hereby incorporated by reference in their entirety.

In particular, an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be administered to a subject having or being prone to a bone mineralization disorder, such as HPP, previously determined to have a plasma PPi concentration of up to about 6 µM (e.g., about 4.5 µM, about 5 µM, or about 5.5 µM or a plasma PPi concentration within the range of about 4.5 µM to about 6 µM). For example, the alkaline phosphatase or the polypeptide having alkaline phosphatase activity is administered to, e.g., an infant or child (e.g., a subject less than about 12 years of age) having a plasma PPi concentration of about 5.71 µM or greater; an adolescent (e.g., a subject of about 13 to about 18 years of age) having a plasma PPi concentration of about 4.78 µM or greater; or an adult (e.g., a subject of greater than about 18 years of age) having a plasma PPi concentration of about 5.82 µM or greater. Additionally, an alkaline phosphatase or a polypeptide having alkaline phosphatase activity can be administered to a subject (e.g., a human) having or being prone to a bone mineralization disorder, such as HPP, previously determined to have a plasma ALP concentration of, e.g., about 90 U/L or less for a subject of 0 to 14 days of age; about 134 U/L or less for a subject of 15 days of age to less than 1 year of age; about 156 U/L or less for a subject of about 1 year of age to less than 10 years of age; about 141 U/L or less for a subject of about 10 years of age to less than about 13 years of age; about 62 U/L or less for a female subject of about 13 years of age to less than about 15 years of age; about 127 U/L or less for a male subject of about 13 years of age to less than about 15 years of age; about 54 U/L or less for a female subject of about 15 years of age to less than about 17 years of age; about 89 U/L or less for a male subject of about 15 years of age to less than about 17 years of age; about 48 U/L or less for a female subject of about 17 years of age or older; or about 59 U/L or less for a male subject of about 17 years of age or older.

The plasma PPi concentration and/or plasma ALP concentration of a subject (e.g., a human) having or being prone to a bone mineralization disorder, such as HPP, can be compared to the plasma PPi concentration and/or plasma ALP of a normal subject to determine a treatment effect in the subject administered an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). In particular, the alkaline phosphatase or the polypeptide having alkaline phosphatase activity can be administered for a treatment period of least one year (e.g., at least two years, at least three years, at least four years, at least five years, at least six years, at least seven years, at least eight years, at least nine years, at least ten years, or longer than ten years, such as for the lifetime of the subject). Alternatively, the methods can include determining the plasma PPi concentration and/or plasma ALP concentration prior to administering the alkaline phosphatase or the polypeptide having alkaline phosphatase activity to assess an effect in the subject of treatment with the alkaline phosphatase or the polypeptide having alkaline phosphatase activity.

The methods result in a decrease in PPi and/or an increase in ALP concentration in a sample (e.g., a plasma sample) from a subject (e.g., a human subject) having or being prone to a bone mineralization disorder, such as HPP. For example, treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) results in a decrease in PPi concentration in a sample (e.g., a plasma sample) from the subject of about 1 µM, about 1.5 µM, about 2 µM, about 2.5 µM, or about 3 µM or 25% or greater (e.g., 30%, 35%, 40%, 45%, 50%, 55%, 60%, or more than 60%). Thus, the subject exhibits a plasma PPi concentration of, e.g., about 2 µM to about 5 µM, about 3 µM to about 5 µM, about 2 µM to about 4 µM, or about 2 µM to about 3 µM after administration of the alkaline phosphatase or the polypeptide having alkaline phosphatase activity.

Likewise, treatment with alkaline phosphatase or a polypeptide having alkaline phosphatase activity results in an increase in ALP concentration in a sample (e.g., a plasma sample) from a subject (e.g., a human) having or being prone to a bone mineralization disorder, such as HPP, of 30%, 35%, 40%, 45%, 50%, 55%, 60%, or more than 60%, relative to the subject prior to administration of the alkaline phosphatase or a polypeptide having alkaline phosphatase activity. For example, administration of the alkaline phosphatase or the polypeptide having alkaline phosphatase activity increases the ALP concentration in a sample (e.g., a plasma sample) from the subject to, e.g., about 273 U/L or greater for a subject of 0 to 14 days of age; about 518 U/L or greater for a subject of 15 days of age to less than 1 year of age; about 369 U/L or greater for a of about 1 year of age to less than 10 years of age; about 460 U/L or greater for a subject of about 10 years of age to less than about 13 years of age; about 280 U/L or greater for a female subject of about 13 years of age to less than about 15 years of age; about 517 U/L or greater for a male subject of about 13 years of age to less than about 15 years of age; about 128 U/L or greater for a female subject of about 15 years of age to less than about 17 years of age; about 365 U/L or greater for a male subject of about 15 years of age to less than about 17 years of age; about 95 U/L or greater for a female subject of about 17 years of age or older; or about 164 U/L or greater for a male subject of about 17 years of age or older.

The decrease in the plasma PPi and/or increase in the ALP concentrations of the subject (e.g., a human) having or being prone to a bone mineralization disorder, such as HPP, can be sustained throughout administration of the alkaline phosphatase or the polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). For instance, the plasma PPi concentration decreases by about 25% and remains at ±10% of the decreased plasma PPi concentration during treatment with the sALP and/or the plasma ALP concentration increases by about 50% and remains at ±10% of the increased plasma ALP concentration during treatment with the alkaline phosphatase or the polypeptide having alkaline phosphatase activity.

Alternatively, when administration of an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) does not result in an average decrease in PPi concentrations in a plasma sample from the subject (e.g., a human) having or being prone to a bone mineralization disorder, such as HPP, by about 25% or greater, the dosage and/or frequency of sALP administration can be changed in order to determine an effective amount of the sALP for the subject. Likewise, when administration of an alkaline phosphatase or a polypeptide having alkaline phosphatase activity does not result in an average increase in ALP concentrations in a plasma sample from the subject by about 50% or greater, the dosage and/or frequency of alkaline phosphatase or a polypeptide having alkaline phosphatase activity administration can be changed in order to determine an effective amount of the alkaline phosphatase or a polypeptide having alkaline phosphatase activity for the subject. For instance, the dosage of the alkaline phosphatase or a polypeptide having alkaline phosphatase activity can be increased from, e.g., about 0.5 mg/kg/week or about 3.5 mg/kg/week to about 3-6 mg/kg/week or about 6-9 mg/kg/week.

Bruininks-Oseretsky Test of Motor Proficiency $2^{nd}$ Edition (BOT-2)

An exemplary Bruininks-Oseretsky Test of Motor Proficiency $2^{nd}$ Edition (BOT-2) is described in Bruininks, R. H. (2005). *Bruininks-Oseretsky Test of Motor Proficiency*, (BOT-2), Minneapolis. MN: Pearson Assessment, hereby incorporated by reference in its entirety. In particular, the BOT-2 can be used to evaluate physical impairments and mobility restrictions in a subject having or being prone to a bone mineralization disorder (e.g., HPP) to generate a BOT-2 score for the subject.

The BOT-2 includes a range of tests to evaluate physical impairments of a subject, which can be performed with, e.g., a kit including the tests. The BOT-2 provides composite BOT-2 scores in the following areas: strength, running speed and agility, fine motor precision, fine motor integration, manual dexterity, bilateral coordination, balance, and upper-limb coordination. For example, a subject having or being prone to a bone mineralization disorder, such as HPP, can perform sit-ups, v-ups, standing long jump, wall sit, and/or push-ups to determine the BOT-2 strength score. A subject having or being prone to a bone mineralization disorder, such as HPP, can step over a balance beam and/or perform a shuttle run, two-legged side hop, and/or one-legged side hop to determine the BOT-2 running speed and agility score. A subject having or being prone to a bone mineralization disorder, such as HPP, can cut out a circle and/or connect dots to determine the BOT-2 fine motor precision score. A subject having or being prone to a bone mineralization disorder, such as HPP, can copy a star and/or copy a square to determine the BOT-2 fine motor integration score. A subject having or being prone to a bone mineralization disorder, such as HPP, can transfer pennies, sort cards, and/or string blocks to determine the manual dexterity score. A subject having or being prone to a bone mineralization disorder, such as HPP, can tap his or her foot and finger and/or perform jumping jacks to determine the BOT-2 bilateral coordination score. A subject having or being prone to a bone mineralization disorder, such as HPP, can walk forward on a line and/or stand on one leg on a balance beam to determine the BOT-2 balance score. A subject having or being prone to a bone mineralization disorder, such as HPP, can throw a ball at a target and/or catch a tossed ball to determine the BOT-2 upper-limb coordination score.

A subject having or being prone to a bone mineralization disorder, such as HPP, could perform tests in one or more of described areas (strength, running speed and agility, fine motor precision, fine motor integration, manual dexterity, bilateral coordination, balance, and upper-limb coordination) to generate a BOT-2 score indicative of physical impairments in the subject. Within each BOT-2 area (strength, running speed and agility, fine motor precision, fine motor integration, manual dexterity, bilateral coordination, balance, and upper-limb coordination), such subject could perform one or more tests to determine the BOT-2 score of the subject, e.g., the subject could perform one or more of sit-ups, v-ups, standing long jump, wall sit, and push-ups to determine the BOT-2 strength score. Thus, only one test (e.g., one test selected from the group of sit-ups, v-ups, standing long jump, wall sit, and push-ups) can be performed to determine the BOT-2 score (e.g., a BOT-2 strength score) of a subject having or being prone to a bone mineralization disorder, such as HPP, (e.g., an HPP-like disease).

Each of the BOT-2 scores (strength, running speed and agility, fine motor precision, fine motor integration, manual dexterity, bilateral coordination, balance, and upper-limb coordination) of the subject having or being prone to a bone mineralization disorder, such as HPP, can be compared to the BOT-2 score of a subject without the bone mineralization disorder, such as HPP, to, e.g., determine a baseline comparison of the BOT-2 score. Each of the BOT-2 scores (e.g., strength, running speed and agility, fine motor precision, fine motor integration, manual dexterity, bilateral coordination, balance, and upper-limb coordination) of the subject having or being prone to a bone mineralization disorder, such as HPP, can be compared to the BOT-2 score of other subjects having or being prone to the bone mineralization disorder, such as HPP, to, e.g., provide a relative BOT-2 score for the subject.

BOT-2 scores (e.g., strength, running speed and agility, fine motor precision, fine motor integration, manual dexterity, bilateral coordination, balance, and upper-limb coordination scores) range from about 0 to equal to or less than about 25, in which a score of about 10 to about 20 is considered representative of healthy subject (e.g., subject without the bone mineralization disorder, such as HPP). A subject with an average BOT-2 score (e.g., strength, running speed and agility, fine motor precision, fine motor integration, manual dexterity, bilateral coordination, balance, and upper-limb coordination scores) of less than about 10 can be treated with an alkaline phosphatase, or a polypeptide having alkaline phosphatase activity, e.g., sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein.

For example, a subject having or being prone to a bone mineralization disorder, such as HPP, with a BOT-2 strength score of less than 10 (e.g., about 0, about 1, about 2, about 3, about 4, about 5, about 6, about 7, about 8, about 9, or about 10) can be treated with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) for a period of time, up to the lifetime of the subject. Likewise, a subject having or being prone to a bone mineralization disorder, such as HPP, with a BOT-2 running speed and agility score of less than 10 (e.g., about 0, about 1, about 2, about 3, about 4, about 5, about 6, about 7, about 8, about 9, or about 10) can then be treated with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) for a period of time, up to the lifetime of the subject.

The methods can result in an improvement in the BOT-2 score (e.g., strength, running speed and agility, fine motor precision, fine motor integration, manual dexterity, bilateral coordination, balance, and/or upper-limb coordination score) of a subject having or being prone to a bone mineralization disorder, such as HPP. For example, treatment with an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with a sALP for a period of time, can result in an average increase in the BOT-2 strength score to about 10 to about 20 (e.g. about 10, about 11, about 12, about 13, about 14, about 15, about 16, about 17, about 18, about 19, or about 20). Additionally, treatment with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can result in an average increase in the BOT-2 running speed and agility score to about 5 to about 20 (e.g. about 5, about 6, about 7, about 8, about 9, about 10, about 11, about 12, about 13, about 14, about 15, about 16, about 17, about 18, about 19, or about 20).

The increase in the BOT-2 score (e.g., strength, running speed and agility, fine motor precision, fine motor integration, manual dexterity, bilateral coordination, balance, and/or upper-limb coordination score) can be sustained throughout administration of the alkaline phosphatase, or the polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a period of time. Likewise, the decrease in physical impairments of muscles after administration of the alkaline phosphatase, or the polypeptide having alkaline phosphatase activity, can be sustained throughout administration of the alkaline phosphatase, or the polypeptide having alkaline phosphatase activity.

The BOT-2 scores (strength, running speed and agility, fine motor precision, fine motor integration, manual dexterity, bilateral coordination, balance, and upper-limb coordination scores) of a subject having or being prone to a bone mineralization disorder, such as HPP, can be used singly or in combination with other metrics for assessing treatment efficacy using an alkaline phosphatase, or a polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the alkaline phosphatase, or the polypeptide having alkaline phosphatase activity, is effective for treating muscle impairments associated with the bone mineralization disorder, such as HPP. For example, when administration of a sALP described herein to a subject having or being prone to a bone mineralization disorder, such as HPP, results in an average increase in the BOT-2 running speed and agility score to about 5 or greater than about 5, in which the subject previously had an average BOT-2 running speed and agility score of less than about 5, then the sALP is considered to be effective at, e.g., treating physical impairments associated with a bone mineralization disorder, such as HPP.

Additionally, within each BOT-2 area (strength, running speed and agility, fine motor precision, fine motor integration, manual dexterity, bilateral coordination, balance, and upper-limb coordination), a subject having or being prone to a bone mineralization disorder, such as HPP, could perform one or more tests to determine the BOT-2 score of the subject.

Alternatively, when administration of an alkaline phosphatase, or a polypeptide having alkaline phosphatase activity, such as a sALP described herein, does not result in an average increase in the BOT-2 running speed and agility score to greater than about 5, the dosage and/or frequency of administration can be changed in order to determine the effective amount of the alkaline phosphatase, or the polypeptide having alkaline phosphatase activity, for the subject having or being prone to the bone mineralization disorder, such as HPP. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Childhood Health Assessment Questionnaire (CHAQ)

The Childhood Health Assessment Questionnaire (CHAQ) can be administered to evaluate the health status of children having a bone mineralization disorder, such as HPP, to generate a CHAQ index score for the child, as is described in Bruce & Fries (*J. Rheumatol,* 30(1): 167-178, 2003) and Klepper (*Arthritis & Rheumatism,* 49: S5-S14, 2003), hereby incorporated by reference in their entirety. The CHAQ includes eight categories of questions for dressing/grooming, arising, eating, walking, hygiene, reach, grip, and activities, in which a parent or guardian records the amount of difficulty the child with the bone mineralization disorder, such as HPP, has in performing the respective activities. The range of scores within each category is from 0 to 3, in which a score of 0 indicates without any difficulty; a score of 1 indicates with some difficulty; a score of 2 indicates with much difficulty; and a score of 3 indicates that the child is unable to perform the activity.

Children having or being prone to a bone mineralization disorder, such as HPP, with an average CHAQ index score (e.g., indicative of disability in activities of daily living (ADL) and/or pain) greater than about 0.8 (e.g., about 0.8, about 1, about 1.2, about 1.4, about 1.6, about 1.8, about 2.0, about 2.2, about 2.4, about 2.6, about 2.8, or about 3.0) can be treated by administering an alkaline phosphatase, or a polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). For example, children with an average CHAQ index score of greater than about 0.8 can be treated by administering an alkaline phosphatase, or a polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) for a period of time, up to the lifetime of the subject. Furthermore, a child having or being prone to a bone mineralization disorder, such as HPP, disclosed herein could be asked one or more questions in one or more of the eight categories (dressing/grooming, arising, eating, walking, hygiene, reach, grip, and activities) to arrive at an average CHAQ index score, and if the average CHAQ index score is greater than about 0.8, the child can be treated by administering an alkaline phosphatase, or a polypeptide having alkaline phosphatase activity, such as a sALP.

The CHAQ index score of a child having or being prone to a bone mineralization disorder, such as HPP, disclosed herein can be compared to the CHAQ index score of children without such bone mineralization disorder, such as HPP, to, e.g., determine the standard deviation of the CHAQ index score. Additionally, the CHAQ index score of a child having or being prone to a bone mineralization disorder, such as HPP, disclosed herein can be compared to the CHAQ index score of other children having or being prone to the bone mineralization disorder, such as HPP, disclosed herein to, e.g., determine the standard deviation of the CHAQ index score.

The methods can result in an improvement in the CHAQ index score (e.g., indicative of disability in ADL and/or pain) of the child having or being prone to a bone mineralization disorder, such as HPP, disclosed herein. For example, treatment with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with a sALP for a period of time, up to the lifetime of the child, can result in an average decrease in the CHAQ index score to about 0 to equal to or less than about 0.5 (e.g. about 0, about 0.1, about 0.2, about 0.4, or about 0.5) in children with an HPP-like disease.

The decrease in the CHAQ index score of the child having or being prone to a bone mineralization disorder, such as HPP, can be sustained throughout administration of the alkaline phosphatase, or the polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a period of time, up to the lifetime of the child. Likewise, the increase in ADL and/or decrease in pain of the child can be sustained throughout administration of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), for a period of time, up to the lifetime of the child.

The CHAQ index score of a child having or being prone to a bone mineralization disorder, such as HPP, can be used to assess treatment efficacy using an alkaline phosphatase, or a polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the alkaline phosphatase, or the polypeptide having alkaline phosphatase activity, is effective for treating, e.g., disability in activities of daily living (ADL) and pain associated with the bone mineralization disorder, such as HPP. In particular, a child having or being prone to a bone mineralization disorder, such as HPP, could be asked one or more questions in one or more of the eight categories (dressing/grooming, arising, eating, walking, hygiene, reach, grip, and activities) to arrive at an average CHAQ index score and to assess treatment efficacy of sALP administration. For example, when administration of a sALP described herein to a child having or being prone to a bone mineralization disorder, such as HPP, results in an average decrease in the CHAQ index score to equal to or less than about 0.5, in which the child previously had an average CHAQ index score of greater than about 0.8, then the sALP is effective at treating, e.g., disability in activities of daily living (ADL) and pain associated with a bone mineralization disorder, such as HPP. Alternatively, when administration of a sALP does not result in an average decrease in the CHAQ index score to equal to or less than about 0.5, the dosage and/or frequency of sALP administration can be changed in order to determine the effective amount of the sALP for the child having or being prone to a bone mineralization disorder, such as HPP. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Pediatric Outcomes Data Collection Instrument (PODCI)

Certain subjects having or being prone to a bone mineralization disorder, such as HPP, can be identified for treatment with an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) using the Pediatric Outcomes Data Collection Instrument (PODCI). The PODCI can be administered to evaluate the health status of children to generate a PODCI score for the subject, as is described in Plint et al. (*J. Pediatr. Orthop.* 23(6): 788-790, 2003). The PODCI includes eight categories of questions that can be completed by a subject having or being prone to a bone mineralization disorder, such as HPP, or by a parent/guardian of the subject. Categories that can be used to determine the PODCI of a subject having or being prone to a bone mineralization disorder, such as HPP, include the following: 1) the upper extremity and physical function scale to measure difficulty encountered in performing daily personal care and student activities; 2) the transfer and basic mobility scale to measure difficulty experienced in performing routine motion and motor activities in daily activities; 3) the sports/physical functioning scale to measure difficulty or limitations encountered in participating in more active activities or sports; 4) the pain/comfort scale to measure the level of pain experienced during the past week; 5) the treatment expectations scale to measure the long term expectations of treatment; 6) the happiness scale to measure overall satisfaction with personal looks and sense of similarity to friends and others of own age; 7) the satisfaction with symptoms scale to measure the subject's acceptance of current limitations should this be a life-long state; and 8) the global functioning scale, which is a general combined scale calculated from the first four scales listed above. In each of the categories, a standardized score is determined for the subject having or being prone to a bone mineralization disorder, such as HPP, and then converted to a 0 to 100 scale, in which 0 represents significant disability and 100 represents less disability.

A subject having or being prone to a bone mineralization disorder, such as HPP, with an average PODCI score (e.g., indicative of disability in ADL and/or pain) less than about 40 (e.g., about 5, about 10, about 15, about 20, about 25, about 30, about 35, or about 39) can be treated by administering an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). For example, a subject with an average PODCI score of less than 40 can be treated by administering a sALP for a period of time, up to the lifetime of the subject. Furthermore, a subject having or being prone to a bone mineralization disorder, such as HPP, could be asked one or more questions in one or more of the eight scales described above (e.g., transfer and basic mobility, sports/physical functioning, and the pain/comfort scale) to arrive at an average PODCI score, and if the average PODCI score is greater than less than 40, the subject can be treated by administering a sALP.

The methods described herein can result in an increase in the PODCI score (e.g., indicative of disability in ADL and/or pain) of the subject having or being prone to a bone mineralization disorder, such as HPP. For example, treatment with an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with a sALP for a period of time, up to the lifetime of the subject, can result in an average increase in the PODCI score to about 40 to about 50 (e.g. about 40, about 41, about 42, about 43, about 44, about 45, about 46, about 47, about 48, about 49, or about 50).

The increase in the PODCI score can be sustained throughout administration of the alkaline phosphatase, or the polypeptide having alkaline phosphatase activity, such as the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a period of time, up to the lifetime of the subject having or being prone to a bone mineralization disorder, such as HPP. Likewise, the increase in ADL and/or decrease in pain can be sustained throughout administration of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), for a period of time, up to the lifetime of the subject.

The PODCI score of a subject having or being prone to a bone mineralization disorder, such as HPP, can be used to assess treatment efficacy using an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the alkaline phosphatase, or the polypeptide having alkaline phosphatase activity, is effective for treating, e.g., disability in activities of daily living (ADL) and pain associated with the bone mineralization disorder, such as HPP. In particular, a subject having or being prone to a bone mineralization disorder, such as HPP, could be asked one or more questions in one or more of the eight scales (the upper extremity and physical function scale, the transfer and basic mobility scale, the sports/physical functioning scale, the pain/comfort scale, the treatment expectations scale, the happiness scale, the satisfaction with symptoms scale, and the global functioning scale) to arrive at an average PODCI score and to assess treatment efficacy of sALP administration.

For example, when administration of a sALP described herein to a subject having or being prone to a bone mineralization disorder, such as HPP, results in an average increase in the PODCI score to about 40 or greater than about 40, in which the subject previously had an average PODCI score of less than about 40, then the sALP is effective at treating, e.g., disability in activities of daily living (ADL) and pain associated with a bone mineralization disorder, such as HPP. Alternatively, when administration of a sALP described herein does not result in an average increase in the PODCI score to about 40 or greater than about 40, the dosage and frequency of sALP administration can be changed in order to determine the effective amount of the sALP for the subject having or being prone to a bone mineralization disorder, such as HPP. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Bayley Scales of Infant and Toddler Development, $3^{rd}$ Edition (BSID-III)

Another endpoint, the Bayley Scales of Infant and Toddler Development, 3rd Edition (BSID-III) can be administered to evaluate the health status of a subject having or being prone to a bone mineralization disorder, such as HPP, from birth to generate a BSID-III score for the subject, as is described in Bayley. (2006). *Bayley scales of infant and toddler development: administration manual*. San Antonio, TX: Harcourt Assessment. The BSID-III includes a series of developmental play tasks that can be administered to the subject to determine the raw BSID-III score. For example, categories for determining the BSID-III score of a subject having or being prone to a bone mineralization disorder, such as HPP, (e.g., infants of about three years of age or less having HPP) can include prehension, perceptual-motor integration, motor planning and speed, visual tracking, reaching, object grasping, object manipulation, functional hand skills, responses to tactile information, movement of the limbs and torso, static positioning, dynamic movement, balance, and motor planning. The BSID-III measurements are then converted to scaled BSID-III scores, which can be used to determine the subject's performance compared to healthy, age-adjusted subjects. The BSID-III scaled score of a subject having or being prone to a bone mineralization disorder, such as HPP, (e.g., a subject with HPP) can range from 0 to 14, in which scores of about 7 to about 13 are considered the normal range for a healthy subject.

A subject having or being prone to a bone mineralization disorder, such as HPP, could perform tests in one or more of described categories (prehension, perceptual-motor integration, motor planning and speed, visual tracking, reaching, object grasping, object manipulation, functional hand skills, responses to tactile information, movement of the limbs and torso, static positioning, dynamic movement, balance, and motor planning) as an infant (e.g., at about 3 years of age or less than 3 years of age) to generate a BSID-III score indicative of delayed motor development. A subject having or being prone to a bone mineralization disorder, such as HPP, with an average BSID-III score in one or more of the described categories (prehension, perceptual-motor integration, motor planning and speed, visual tracking, reaching, object grasping, object manipulation, functional hand skills, responses to tactile information, movement of the limbs and torso, static positioning, dynamic movement, balance, and motor planning) less than about 2 as an infant can be treated by administering a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein). In particular, a subject having or being prone to a bone mineralization disorder, such as HPP, with an average BSID-III score of less than about 2 as an infant can be treated by administering a sALP for a period of time, up to the lifetime of the subject.

The methods can result in an improvement in the average BSID-III score (e.g., indicative of delayed motor development) of the subject having or being prone to a bone mineralization disorder, such as HPP. For example, treatment with a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with a sALP for a period of time, up to the lifetime of the subject, can result in an average increase in the BSID-III score to greater than about 5 (e.g., about 5, about 6, about 7, about 8, about 9, about 10, about 11, about 12, or about 13).

The increase in the BSID-III score can be sustained throughout administration of the alkaline phosphatase, or the polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), for a period of time, up to the lifetime of the subject having or being prone to a bone mineralization disorder, such as HPP. Likewise, the increase in motor development can be sustained throughout administration of the alkaline phosphatase, or the polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a period of time, up to the lifetime of the subject.

The BSID-III score of a subject having or being prone to a bone mineralization disorder, such as HPP, can be used to assess treatment efficacy using an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the alkaline phosphatase, or the polypeptide having alkaline phosphatase activity, is effective for treating, e.g., delayed motor development associated with the bone mineralization disorder, such as HPP. In particular, a subject having or being prone to a bone mineralization disorder, such as HPP, could perform tests in one or more of described categories (prehension, perceptual-motor integration, motor planning and speed, visual tracking, reaching, object grasping, object manipulation, functional hand skills, responses to tactile information, movement of the limbs and torso, static positioning, dynamic movement, balance, and motor planning) as an infant (e.g., at about three years of age or less having HPP) to arrive at an average BSID-III score and to assess treatment efficacy of sALP administration.

For example, when administration of a sALP to a child having or being prone to a bone mineralization disorder, such as HPP, results in an average increase in the BSID-III scaled score to greater than about 5, in which the child previously had an average BSID-III scaled score of less than about 2 as an infant (e.g., at about 3 years of age or less than 3 years of age), then the sALP is effective at treating, e.g., delayed motor development associated with an HPP-like disease. Alternatively, when administration of a sALP does not result in an average increase in the BSID-III scaled score to greater than about 5, the dosage and/or frequency of sALP administration can be changed in order to determine the effective amount of the sALP for the child having or being prone to a bone mineralization disorder, such as HPP. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Peabody Developmental Motor Scales, 2nd Edition (PDMS-2)

Another endpoints, the Peabody Developmental Motor Scales, 2nd Edition (PDMS-2), can be administered to evaluate the health status of a subject having or being prone to a bone mineralization disorder, such as HPP, from birth to generate a PDMS-2 score for the subject, as is described in van Hartingsveldt et al. (*Occup. Ther. Int* 12(1): 1-13, 2005). The PDMS-2 includes six categories of subtests to measure motor skills of the subject, such as a subject having HPP.

In particular, PDMS-2 measurements can be determined from the following subtests: 1) the locomotor subtest to measure a subject's ability to move from one place to another (measurements include crawling, walking, running, hopping, and jumping forward); 2) the reflexes subtest to measure a subject's ability to automatically react to environmental events; 3) the stationary subtest to measure a subject's ability to sustain body control within the center of gravity and retain equilibrium; 4) the object manipulation subtest to measure a subject's ability to manipulate an object, such as catching, throwing, and kicking a ball; 5) the grasping subtest to measure a subject's ability to use his or her hands, such as the ability to hold an object with one hand and actions involving the controlled use of the fingers of both hands; and 6) the visual-motor integration subtest to measure a subject's ability to use his or her visual perceptual skills to perform complex eye-hand coordination tasks, such as reaching and grasping for an object, building with blocks, and copying designs. The PDMS-2 measurement can be determined for one or more of these categories for a subject having or being prone to a bone mineralization disorder, such as HPP, and then converted into a PDMS-2 score, such as the PDMS-2 locomotor standard score ranging from 0 to 13, in which the range of healthy subjects (e.g., subjects without the bone mineralization disorder, such as HPP) is from about 7 to about 13.

A subject having or being prone to a bone mineralization disorder, such as HPP, with an average PDMS-score (e.g., indicative of delayed motor development) can be treated by administering a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein).

The methods described herein can result in an improvement in the PDMS-2 score (e.g., indicative of delayed motor development) of the subject having or being prone to a bone mineralization disorder, such as HPP. For example, treatment with an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), can result in an average increase in the PDMS-2 score to about 7 to about 13 (e.g., about 7, about 8, about 9, about 10, about 11, about 12, or about 13).

The increase in the PDMS-2 score can be sustained throughout administration of the alkaline phosphatase, or the polypeptide having alkaline phosphatase activity, such as sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), for an elongated time, e.g., fora period of time, up to the lifetime of the subject having or being prone to a bone mineralization disorder, such as HPP. Likewise, the increase in motor development can be sustained throughout administration of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) for a period of time, up to the lifetime of the subject having or being prone to a bone mineralization disorder, such as HPP.

The PDMS-2 score of a subject having or being prone to a bone mineralization disorder, such as HPP, can be used to assess treatment efficacy using an alkaline phosphatase, or a polypeptide having alkaline phosphatase activity, such as a sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), in which improvements relative to a certain test score demonstrate that the alkaline phosphatase, or the polypeptide having alkaline phosphatase activity, is effective for treating, e.g., delayed motor development associated with the bone mineralization disorder, such as HPP. For example, a child having or being prone to a bone mineralization disorder, such as HPP, could perform tests in one or more of described categories (locomotor, reflexes, stationary, object manipulation, grasping, and visual-motor) at about 5 years of age or less than 5 years of age to arrive at an average PDMS-2 score and to assess treatment efficacy of sALP administration.

For example, when administration of a sALP to a child having or being prone to a bone mineralization disorder, such as HPP, results in an average increase in the PDMS-2 standard score to about 7, in which the child previously had an average PDMS-2 standard score of about 5, then the sALP is effective at treating, e.g., delayed motor development associated with an HPP-like disease. Alternatively, when administration of a sALP does not result in an average increase in the PDMS-2 standard score to about 7, the dosage and/or frequency of sALP administration can be changed in order to determine the effective amount of the sALP for the child. For instance, the dosage of the sALP (e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) can be increased from, e.g., from about 0.5-3 mg/kg/week to about 3-6 mg/kg/week or from about 3-6 mg/kg/week to about 6-9 mg/kg/wk.

Six Minute Walk Test (6MWT)

A subject having a bone mineralization disorder, such as HPP, can be identified for treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) using the 6MWT. In particular, the 6MWT can be used to evaluate walking ability in an adult having a bone mineralization disorder, such as HPP, to generate a 6MWT value for the adult. The 6MWT can be performed indoors or outdoors using a flat, straight, enclosed corridor (e.g., of about 30 meters in length) with a hard surface. A stopwatch or other timer can be used to track the time and a mechanical counter or other device can be used to determine the distance (e.g., in meters) that the subject having a bone mineralization disorder, such as HPP, walks. For instance, the length of the corridor can be marked every three meters to determine the number of meters walked by the subject having a bone mineralization disorder, such as HPP, with the turnaround point at 30 meters and the starting line also marked. The distance walked by the subject having a bone mineralization disorder, such as HPP, in six minutes can then be compared to the predicted number of meters walked, e.g., by a normal subject of about the same age, the same gender, and/or the same height, and expressed as a percentage value to generate the 6MWT value of the subject. The 6MWT value of the subject having a bone mineralization disorder, such as HPP, can be compared to the 6MWT value at baseline of the subject. Additionally, the 6MWT value of the subject having a bone mineralization disorder, such as HPP, can be compared to the 6MWT value of a normal subject.

A subject having a bone mineralization disorder, such as HPP, with an average 6MWT of less than about 80% of the predicted 6MWT value (e.g., relative to a normal subject of about the same age, the same gender, and/or the same height) can be treated with an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as by administering an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks). For example, a subject having a bone mineralization disorder, such as HPP, with an average 6MWT of less than about 80% of the predicted 6MWT value (e.g., about 50%, about 55%, about 60%, about 65%, about 70%, or about 75% of the predicted 6MWT value) can be treated with an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks).

The methods can result in an improvement in the 6MWT value of a subject having a bone mineralization disorder, such as HPP. For example, treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks), can result in an average increase in the 6MWT value to about 80% or greater of the predicted 6MWT value of the subject (e.g., about 82%, about 84%, about 86%, about 88%, about 90%, about 92%, about 94%, about 96%, about 98%, or more of the predictive 6MWT value).

The increase in the 6MWT value of the subject having a bone mineralization disorder, such as HPP, can be sustained throughout administration of the alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks). For instance, the 6MWT value increases to greater than about 80% of the predicted 6MWT value of the subject having a bone mineralization disorder, such as HPP, and remains at ±10% of the increased 6MWT value during treatment with the alkaline phosphatase or a polypeptide having alkaline phosphatase activity.

Likewise, the improvement in walking ability of the subject having a bone mineralization disorder, such as HPP, can be sustained throughout administration of the alkaline phosphatase or a polypeptide having alkaline phosphatase activity, e.g., for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks). For instance, the subject having a bone mineralization disorder, such as HPP, exhibits decreased reliance on an assistive mobility device, such as a walker, a wheelchair, braces, crutches, or orthotics, during treatment with the sALP.

Alternatively, when administration of an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) does not result in an average increase in the 6MWT value to greater than 80% of the predicted 6MWT value (e.g., of a normal subject of about the same age, same gender, and/or height), the dosage and/or frequency of alkaline phosphatase or a polypeptide having alkaline phosphatase activity administration can be changed in order to determine the effective amount of the alkaline phosphatase or a polypeptide having alkaline phosphatase activity for the subject having a bone mineralization disorder, such as HPP. For instance, the dosage of the alkaline phosphatase or a polypeptide having alkaline phosphatase activity can be increased from, e.g., from about 0.1-3 mg/kg/week or about 3-6 mg/kg/week to about 3-6 mg/kg/week or about 6-9 mg/kg/week.

Handheld Dynamometry (HHD)

The grip and muscle strength of a subject having or being prone to a bone mineralization disorder, such as HPP, can be assessed using Hand Held Dynamometry (HHD). For example, knee flexion and extension and also hip flexion, extension, and abduction of a subject having or being prone to a bone mineralization disorder, such as HPP, can be measured using, e.g., a MICROFET2™ Dynamometer, while grip strength of the subject can be measured using, e.g., a Jamar Grip Dynamometer. In particular, the administrator holds the dynamometer stationary, and the subject exerts a maximal force against the dynamometer. Peak force data is collected in pounds, then converted to Newtons (N). Torque values are then calculated using limb length in N-meters. The torque value can then be compared to the torque value of, e.g., a normal subject of about the same age, the same gender, and/or the same height, and expressed as a percentage value to generate the HHD value of the subject.

A subject having a bone mineralization disorder, such as HPP, with an average HHD value of less than about 80% of the predicted HHD value (e.g., relative to a normal subject of about the same age, the same gender, and/or the same height) can be treated with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as by administering an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks). For example, a subject having a bone mineralization disorder, such as HPP, with an average HHD of less than about 80% of the predicted HHD value (e.g., about 30%, about 35%, about 40%, about 45%, about 50%, about 55%, about 60%, about 65%, about 70%, or about 75% of the predicted HHD value) can be treated with an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks).

The methods can result in an improvement in the HHD value of a subject having a bone mineralization disorder, such as HPP. For example, treatment with an alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), such as treatment with an alkaline phosphatase or a polypeptide having alkaline phosphatase activity for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks), can result in an average increase in the HHD value to about 80% or greater of the predicted HHD value of the subject (e.g., about 83%, about 85%, about 87%, about 90%, about 93%, about 95%, about 97%, or about 100%, or about 100% of the predictive HHD value).

The increase in the HHD value of the subject having a bone mineralization disorder, such as HPP, can be sustained throughout administration of the alkaline phosphatase or a polypeptide having alkaline phosphatase activity (e.g. a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein), e.g., for a treatment period of at least two weeks (e.g., at least three weeks, at least four weeks, at least five weeks, at least six weeks, at least seven weeks, at least eight weeks, at least nine weeks, at least ten weeks, at least three months, at least four months, at least five months, at least six months, at least seven months, at least eight months, at least nine months, at least one year, at least two years, at least three years, at least four years, at least five years, at least six years, at least seven years, at least eight years, at least nine years, or at least ten years, or the lifetime of the subject; particularly at least six weeks). For instance, the HHD value increases to greater than about 80% of the predicted HHD value of the subject having a bone mineralization disorder, such as HPP, and remains at ±10% of the increased HHD value during treatment with the alkaline phosphatase or a polypeptide having alkaline phosphatase activity.

Alternatively, when administration of an alkaline phosphatase or a polypeptide having alkaline phosphatase activity (e.g., a sALP, e.g., a polypeptide having the sequence of any one of SEQ ID NOs: 7-223, 247, and 262-264 or a variant thereof with at least 85% sequence identity thereto and/or at least one amino acid mutation relative to a naturally occurring ALP, as described herein) does not result in an average increase in the HHD value to greater than 80% of the predicted HHD value (e.g., of a subject having a bone mineralization disorder, such as HPP, of about the same age, same gender, and/or height), the dosage and/or frequency of alkaline phosphatase or a polypeptide having alkaline phosphatase activity administration can be changed in order to determine the effective amount of the alkaline phosphatase or a polypeptide having alkaline phosphatase activity for the subject having a bone mineralization disorder, such as HPP. For instance, the dosage of the alkaline phosphatase or a polypeptide having alkaline phosphatase activity can be increased from, e.g., from about 0.1-3 mg/kg/week or about 3-6 mg/kg/week to about 3-6 mg/kg/week or about 6-9 mg/kg/week.

EXAMPLES

The disclosure is illustrated by the following examples. It is to be understood that the particular examples, materials, amounts, and procedures are to be interpreted broadly in accordance with the scope and spirit of the disclosure as set forth herein.

Example 1

Protein Design and Expression
Alkaline Phosphatase Fusion Proteins.

To systematically examine protein activity, protein stability, and pharmacokinetic properties of alkaline phosphatase fusion proteins, several constructs were designed and tested (see Table 1). Some constructs were generated by standard DNA synthesis techniques, and their sequences were verified by DNA sequencing of the final constructed plasmids. Additional constructs were generated by performing standard site-directed mutagenesis techniques on existing plasmids. Variations in the alkaline phosphatase fusion proteins tested changes in residues located in and around the active site of the enzyme, at consensus sites of N-linked glycosylation, in the bone targeting moieties, and in the isotype of the fragment crystallizable (Fc) region connected to the protein. These constructs were expressed by transiently transfecting Expi293F and ExpiCHO cells as detailed below.

Bone Targeting Fluorescent-Fc Fusions.

To systematically compare HA and bone binding capabilities of polypeptide and VHH sequences, protein fusions containing (N-terminal bone targeting—human IgG1 crystalline region (Fc)—Katushka2s fluorescent protein—C-terminal His tag) were designed (SEQ ID NOs: 224-245). A list of fluorescent fusion proteins used for targeting is shown in Table 2. Fluorescent fusion proteins were transiently transfected using Expi293F cells as detailed below.

TABLE 2

Summary of bone targeting fluorescent Fc-fusion protein targeting sequences

| Name | Bone Targeting Sequence | Sequence Identifier |
|---|---|---|
| FLU001 | DDDDDDDDDD ($D_{10}$, $Asp_{10}$) | SEQ ID NO: 224 |
| FLU002 | Null | SEQ ID NO: 225 |
| FLU003 | EEEEEEEEEE ($E_{10}$) | SEQ ID NO: 226 |
| FLU004 | C-$D_{10}$-C | SEQ ID NO: 227 |
| FLU005 | VTKHLNQISQSY | SEQ ID NO: 228 |
| FLU006 | NPYHPTIPQSVH | SEQ ID NO: 229 |
| FLU007 | CNYPTLKSC | SEQ ID NO: 230 |
| FLU008 | CMLPHHGAC | SEQ ID NO: 231 |
| FLU009 | SVSVGMKPSPRP | SEQ ID NO: 232 |
| FLU010 | KPRSVSG | SEQ ID NO: 233 |
| FLU011 | DDSWDTNDANVVCRQLGA | SEQ ID NO: 234 |
| FLU012 | KDVVVGVPGGQD | SEQ ID NO: 235 |
| FLU013 | EPRREVAEL | SEQ ID NO: 236 |
| FLU014 | NPPTRQTKPKRVANTN | SEQ ID NO: 237 |
| FLU015 | DSSEEKFLRRIGRFG | SEQ ID NO: 238 |
| FLU016 | DDDDDDDDDDKFLRRIGRFG | SEQ ID NO: 239 |
| FLU017 | KSDGGYYYTQSDY | SEQ ID NO: 240 |
| FLU018 | QVQLVESGGGLVQAGGSLRLSCAASGRTRVM GWFRQAPGKEREFVAAIGRSGTTRYADSVKGR FTISRDNGKNTVYLQMNNLKPEDTAVYYCAAKS DGGYYYTQSDYWGQGTQVTVSS | SEQ ID NO: 241 |
| FLU019 | QVKLEESGGGLVQAGGSLRLSCAASGRTFSTY SMGWFRRAPGKEREFVAAISWSGGTTRYTNSV KGRFTISKDNFGNTVYLQMNNLKPEDTAVYYCA TRYSYSTTPEEYDLWGQGNQVTVSS | SEQ ID NO: 242 |
| FLU020 | QVQLQESGGGLVQPGGSLRLSCSASGFSLDIYA IGWFRQAPGKEREGVSCINSSGSSTYYADSVK GRFTISRDNAKNTIYLQMNSLKPEDTAVYYCAT GGCSPFGGVAGVKDYWGQGTQVTVSS | SEQ ID NO: 243 |
| FLU027 | QVQLVESGGGLVQAGGSLRLSCAASGRTRVM GWFRQAPGKEREFVAAIG*DDDDDDDDDD*TRYA DSVKGRFTISRDNGKNTVYLQMNNLKPEDTAVY YCAAKSDGGYYYTQSDYWGQGTQVTVSS | SEQ ID NO: 244 |
| FLU031 | *DDDDDDDDDD*QVQLQESGGGLVQPGGSLRLS CSASGFSLDIYAIGWFRQAPGKEREGVSCINSS GSSTYYADSVKGRFTISRDNAKNTIYLQMNSLK PEDTAVYYCATGGCSPFGGVAGVKDYWGQGT QVTVSS | SEQ ID NO: 245 |

Biologically Inactive ERT Surrogate Molecules (ALP-Fc).

Figure 21:
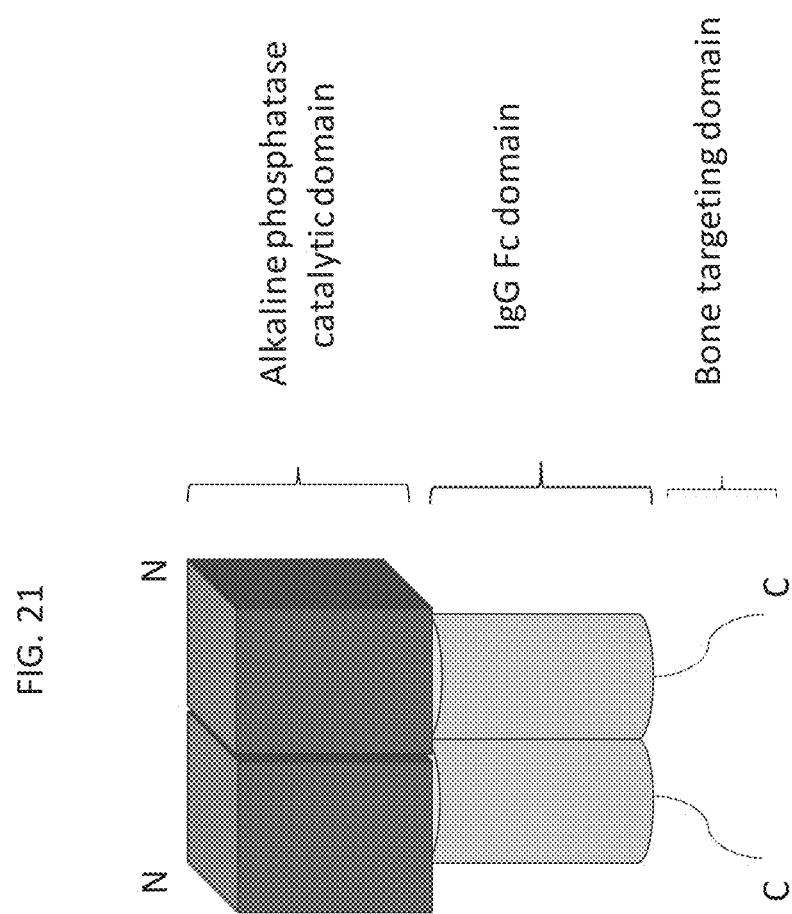
FIG. 21 is a schematic showing an exemplary ALP-Fc-bone tag molecule, with individual domains labeled.

To model the bone targeting capabilities of a clinically available ERT, ALP-Fc-$(Asp)_{10}$ fusions were compared to ALP-Fc fusions. The ALP used for these studies was specifically engineered for enzymatic activity towards a synthetic substrate, 4-methylumbelliferyl phosphate (4-MUP). FIG. 21 shows a structural model of ALP-Fc-$(Asp)_{10}$. ALP-Fc (SEQ ID NO: 222) and ALP-Fc-$(Asp)_{10}$ (SEQ ID NO: 31) proteins were transiently transfected using ExpiCHO cells as detailed below.

Single Domain Variable Heavy Chain of Heavy Chain Only (VHH) Antibody Fragments.

Bone targeted VHH proteins were designed by replacing complementarity determining regions (CDRs) of untargeted VHH molecules with poly aspartic acid sequences. Table 3 shows the list of VHH proteins that were assessed for bone binding. VHH proteins were transiently transfected using Expi293F cells as detailed below.

TABLE 3

Summary of VHH sequences.

| Construct Name | Amino Acid Sequence | SEQ ID NO: |
|---|---|---|
| Control VHH | QVQLVESGGGLVQAGGSLRLSCAASGRTRVM GWFRQAPGKEREFVAAIGRSGTTRYADSVKGR FTISRDNGKNTVYLQMNNLKPEDTAVYYCAAKS DGGYYYTQSDYWGQGTQVTVSSGSHHHHHH | SEQ ID NO: 248 |
| VHH001 | QVQLVESGGGLVQAGGSLRLSCAASGRTRVM GWFRQAPGKEREFVAAIG*DDDDDDD*TRYADSV KGRFTISRDNGKNTVYLQMNNLKPEDTAVYYCA AKSDGGYYYTQSDYWGQGTQVTVSSGSHHHH HH | SEQ ID NO: 249 |
| VHH002 | QVQLVESGGGLVQAGGSLRLSCAASGRTRVM GWFRQAPGKEREFVAAIGDDDDDDDTRYADSV KGRFTISRDNGKNTVYLQMNNLKPEDTAVYYCA A*DDDDDDDDDDDD*YWGQGTQVTVSSGSHHHH HH | SEQ ID NO: 250 |

Cell Culture Transient Transfection

A ratio of 1.0 µg plasmid DNA/mL of transfection culture volume was used for all Expi293 transfections and a ratio of 0.8 µg plasmid DNA/ml of transfection culture volume was used for all ExpiCHO transfection. Cultures were maintained at 120 RPM on shakers with a 25.4 mm throw.

Expi293F cells were cultured in Expi293 Expression Medium (Thermo Fisher) in a humidified 8% $CO_2$ incubator at 37° C. The day prior to transfection, cells were split to $2.5 \times 10^6$ cells/mL. After 24 hours, stocks were approximately $4 \times 10^6$ cells/mL and were diluted to $2.5 \times 10^6$ cells/mL. Expi293 transfections were performed according to the manufacturer's protocol. The Expi293 Expression System Kit (Thermo Fisher), which contains transfection enhancers and ExpiFectamine 293 transfection reagent, was used for all Expi293 transfections. In summary, ExpiFectamine 293 transfection reagent and plasmid DNA were separately diluted in OptiMEM media (Thermo Fisher). ExpiFectamine 293 and DNA mixtures were combined and incubated for an additional 10-20 minutes. ExpiFectamine 293-DNA-OptiMEM mixture was then added to cells. Enhancer 1 and Enhancer 2 were added to transfected cultures 16-18 hours post-transfection.

ExpiCHO-S cells were cultured in ExpiCHO Expression medium (Thermo Fisher) in a humidified 8% $CO_2$ incubator at 37° C. The day prior to transfection, cells were split to $3-4 \times 10^6$ cells/mL. After 24 hours, stocks were $7-10 \times 10^6$ cells/mL and were diluted to $6 \times 10^6$ cells/mL with the addition of fresh media. ExpiCHO transfections were performed using the ExpiCHO Expression System Kit (Thermo Fisher) according to the manufacturer's standard protocol. In summary, ExpiFectamine CHO transfection reagent and plasmid DNA were separately diluted in OptiPRO SFM (Thermo Fisher). ExpiFectamine CHO and DNA mixtures were immediately combined and incubated for 1-5 minutes. ExpiFectamine CHO-DNA-OptiPRO mixture was then added to cells. Enhancer and 30% v/v feed were added 18-22 hours post-transfection.

Cell Culture Harvest

Expi293 transfections were harvested on day 4; ExpiCHO transfections were harvested on day 5. Cell cultures were centrifuged at 1900×g for 15 minutes, and the supernatants were sterile filtered through a 0.2 µm disposable membrane filter (polyethersulfone (PES) filter, Fisher Scientific).

Large Scale Protein Expression

ALP201 and ALP213 were expressed in stable cell culture (CHO KS), grown in 5 L bioreactors (APPLIKON) from initial seeding with $5.0 \times 10^5$ cells/mL, with temperature (36.5° C., with 33° C. shift on day 5), agitation (80 W/m²), and 02 (on demand, 0 to 0.6 VVM) controls, for 11 days, according to standard procedures.

Protein Purification.

Purification of VHH and fluorescent Fc-fusion proteins with Ni-NTA resin. Fluorescent Fc-fusion proteins, possessing a C-terminal His6 tag were purified in batch using Ni-NTA Superflow resin (Qiagen). Cell supernatants were dialyzed against Ni-NTA binding/wash buffer (2.5 M sodium chloride, 0.1 M sodium phosphate, 0.1 M imidazole, buffered to pH 7.4 with sodium hydroxide) for 48 hours at 4° C., using dialysis flasks (Slide-A-Lyzer™, ThermoFisher). Ni-NTA Superflow resin was washed and resuspended in Ni-NTA binding/wash buffer prior to incubation with dialyzed supernatants (~8 mg protein per mL resin) for 90 minutes with shaking at 4° C. Gravity purification columns were sanitized with 0.1 N sodium hydroxide for 1 hour, followed by rinsing with Ni-NTA binding/wash buffer prior to protein loading/elution. Dialyzed supernatants containing Ni resin were poured into columns and unbound protein suspension was allowed to flow through resin. Resin-bound protein was washed with 40 column volumes (~200 mL) Ni-NTA binding/wash buffer. Fluorescent Fc-fusion proteins were eluted in 3 fractions by adding 5 mL elution buffer (20 mM sodium phosphate pH 7.0, 500 mM imidazole pH 7.5, 500 mM sodium chloride) and allowing 5 minutes of buffer incubation with resin prior to elution into conical tubes. Eluted proteins were buffer exchanged into PBS pH 7.4 using 30 kD MWCO centrifugal filters (Amicon®), and final concentrated proteins were filtered. Protein concentrations were quantified using UV/VIS absorbance at 280 nm and 558 nm (maximum Katushka 2s absorbance), and subsequently stored at 4° C. protected from light.

Purification of ALP-Fc Fusions with Protein A Resin.

ALP-Fc fusions were purified in batch using protein A resin (MABSELECT™ SURE™, GE Life Sciences). Resin was thoroughly washed and suspended in protein loading buffer (50 mM sodium phosphate, pH 7.5, 100 mM sodium chloride) prior to overnight incubation (at 4° C.) with cell supernatants containing expressed target proteins (~10 mg protein per mL resin). Gravity columns were sanitized with sodium hydroxide, rinsed with loading buffer, and loaded with protein A resin/supernatants. Resin-bound proteins were washed with 40 column volumes (~200 mL) loading buffer prior to elution with 50 mM Tris-HCl pH 11. Proteins were eluted in 3 mL fractions and immediately neutralized by 1:1 dilution with loading buffer. Certain samples were additionally purified by strong anion exchange chromatography (CAPTO™ Q IMPRES, 5 mL columns; column washing buffer 20 mM sodium phosphate buffer, pH 7.4, Buffer A; gradient elution between Buffer A and Buffer B (20 mM sodium phosphate, 1M NaCl, pH 7.4) over 12 column volumes starting at 25% Buffer B to 100% Buffer B). Fractions containing ALP-Fc fusions were pooled and either dialyzed into PBS pH 7.4 or buffer exchanged into PBS pH 7.4 using 30 kD MWCO centrifugal filters. Protein concentrations were determined via absorbance at 280 nm and purity was assessed by SDS-PAGE gels. Proteins were filtered and stored at 4° C.

Large Scale Protein Purification

Proteins from stable cell line bioreactor expression were purified similarly to previous samples, except the strong anion exchange chromatography was performed using POROS™ 50HQ columns, with the same buffers at a 0% to 70-75% gradient Buffer B over 13-15 column volumes. Samples were concentrated via UF/DF or dialyzed into PBS, sterile filtered, and stored at 4° C. (sample concentration was typically approximately 4-8 mg/mL).

Example 2

4-Methylumbelliferyl Phosphate Hydrolysis Protein Activity Assay

Alkaline phosphatase activity was routinely measured using an artificial substrate, 4-methylumbelliferyl phosphate (4-MUP). Cleavage of the phosphoester bond on 4-MUP yields a fluorescent product, 4-methylumbelliferrone (4-MU), which can be detected at 360 nm/465 nm excitation/emission.

Figure 19:
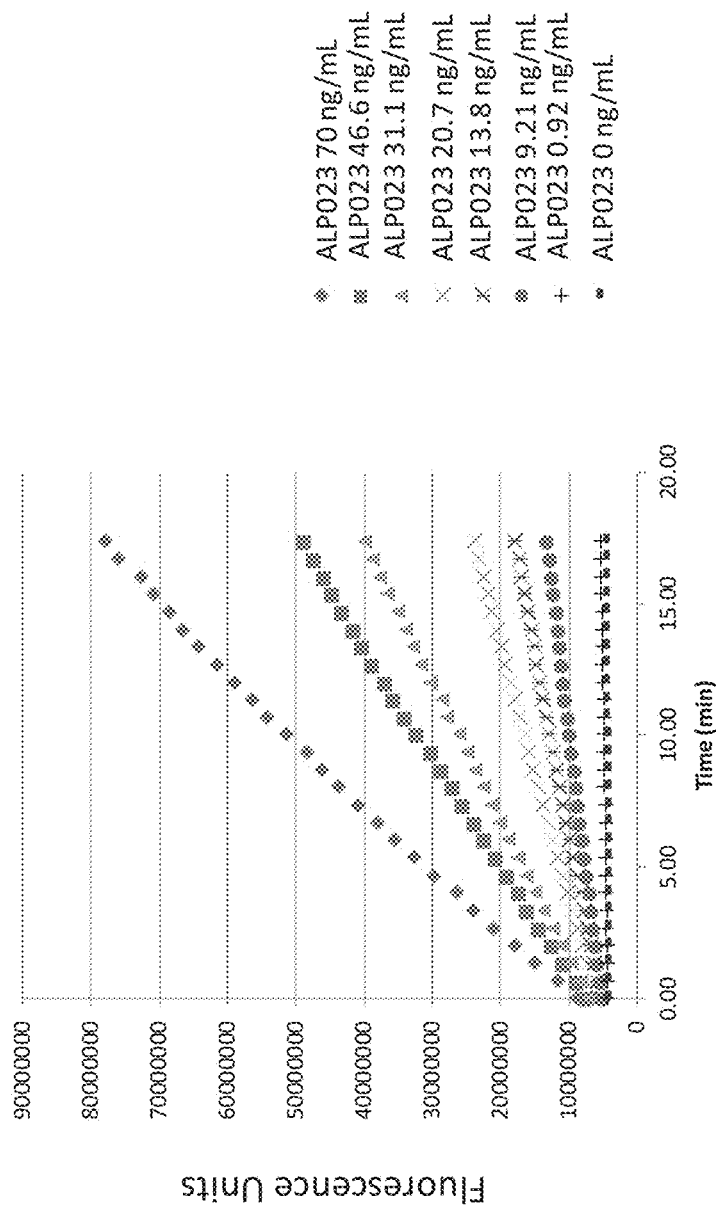
FIG. 19 is a graph showing an exemplary progress curve of a 4-methylumbelliferyl phosphate (MUP) hydrolysis assay, with fluorescence plotted versus time, using ALP023 at various concentrations.

Protein samples (supernatant, partially purified, or column purified samples) were assayed for ALP activity in solution using 4-methylumbelliferyl phosphate (4-MUP) as an artificial substrate. Hydrolysis of the phosphoester bond in 4-MUP releases the fluorescent compound 4-methylumbelliferone, which is easily detected by a fluorimeter. Product quantitation was performed using a 4-methylumbelliferone (4-MU) standard curve measured on the same plate, with standard concentrations at 0, 1.25 uM, 2.5 uM, 5 uM, 10 uM, and 20 uM. A 10 mM stock solution of 4-MU was prepared in ethanol and diluted into assay buffer [50 mM HEPES pH 7.4, 150 mM NaCl, 1 mM $MgCl_2$, 1 mg/mL bovine serum albumin]. Purified fusion protein samples were prepared as 0.1 mg/mL solutions in assay buffer, and serially diluted to an appropriate final concentration (usually, approximately 1 nM) for assay in assay buffer. 4-MUP stock solutions were prepared in assay buffer. All solutions were brought to 37° C. prior to initiation of the assay by addition of 4-MUP to the protein sample at a final concentration of 10 uM. Production of 4-MU was measured at an excitation wavelength of 360 nm and an emission wavelength of 465 nm. Data were collected in a plate reader held at 37° C., every 40 seconds, for a total of 20 minutes. Rates of reaction were calculated by linear regression in units of activity, where 1 U=1 micromole 4-MUP hydrolyzed/minute. Specific activities were calculated in Units/mg of protein assayed. Progress curves for the 4-MUP hydrolysis assay are shown in FIG. 19. Specific activities in Table 4 were as follows: <2 U/mg (−), 2-9.9 U/mg (+), 10-30 U/mg (++), and >30 U/mg (+++).

TABLE 4

Specific activity for 4-MUP Hydrolysis for Exemplary Alkaline Phosphatase Fusion Proteins

| Construct | MUP activity |
| --- | --- |
| ALP035, ALP039, ALP133, ALP134, ALP136, ALP137, ALP138, ALP139, ALP142, ALP143, ALP187, ALP201, ALP235, ALP259 | +++ |
| ALP001, ALP004, ALP011, ALP012, ALP023, ALP031, ALP043, ALP047, ALP048, ALP049, ALP050, ALP051, ALP052, ALP053, ALP054, ALP055, ALP056, ALP057. ALP058, ALP058, ALP059, ALP060, ALP062, ALP063, ALP089, ALP132, ALP144, ALP147, ALP148, ALP151, ALP155, ALP156, ALP157, ALP158, ALP170, ALP173, ALP174, ALP185, ALP186, ALP188, ALP213, ALP214, ALP215 | ++ |
| ALP002, ALP044, ALP045, ALP130, ALP135, ALP140, ALP145, ALP146, ALP149, ALP150, ALP152, ALP163, ALP169, | + |
| ALP003, ALP013, ALP040, ALP041, ALP164, ALP165, ALP166, ALP168 | − |

Plate Bone Assay Bone homogenate fractions were assayed for ALP activity. The bone homogenate fractions were suspended in 100 μL PBS and transferred to 96-well black plates. 100 μL unbound protein suspensions were also transferred to separate wells of the 96-well plate. To each well, 100 μL of ALP detection solution (10 μM 4-MUP, 1% BSA) was added and kinetic fluorescent reading (at 360/465) was immediately initiated and run for 20 minutes, with fluorescent intensity emissions collected every 30 seconds. The slope of fluorescence intensity vs. time represented ALP concentration in each sample fraction.

Figure 11:
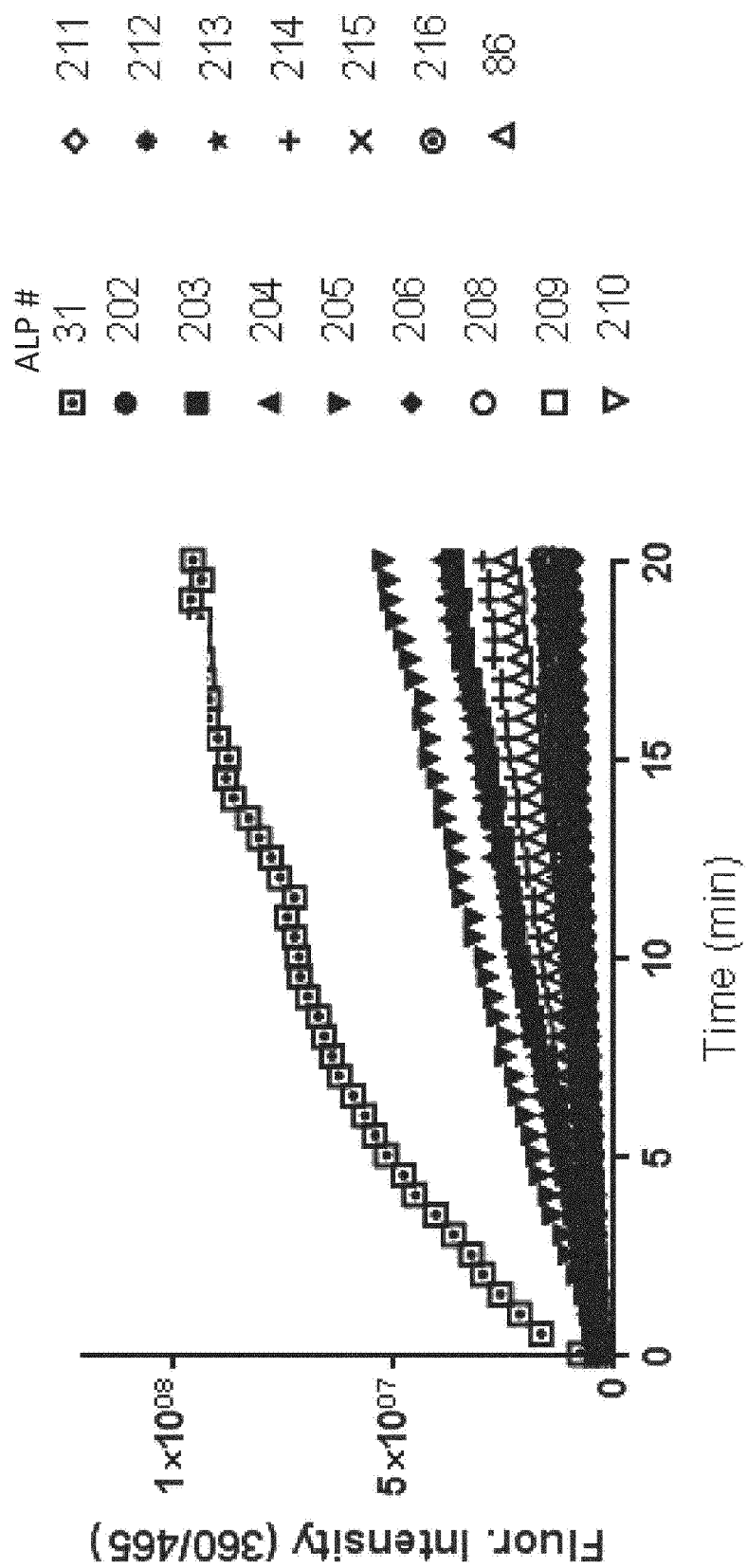
FIG. 11 is a graph showing MUP fluorescence intensity generated by sixteen bone-tagged fusion proteins bound to bone homogenate as a function of time (ALP031 (ALP-Fc-D10), ALP086 (ALP-Fc), and ALP202-ALP216, corresponding to SEQ ID NOs: 31, 222, and 124-138, respectively.
Figure 12:
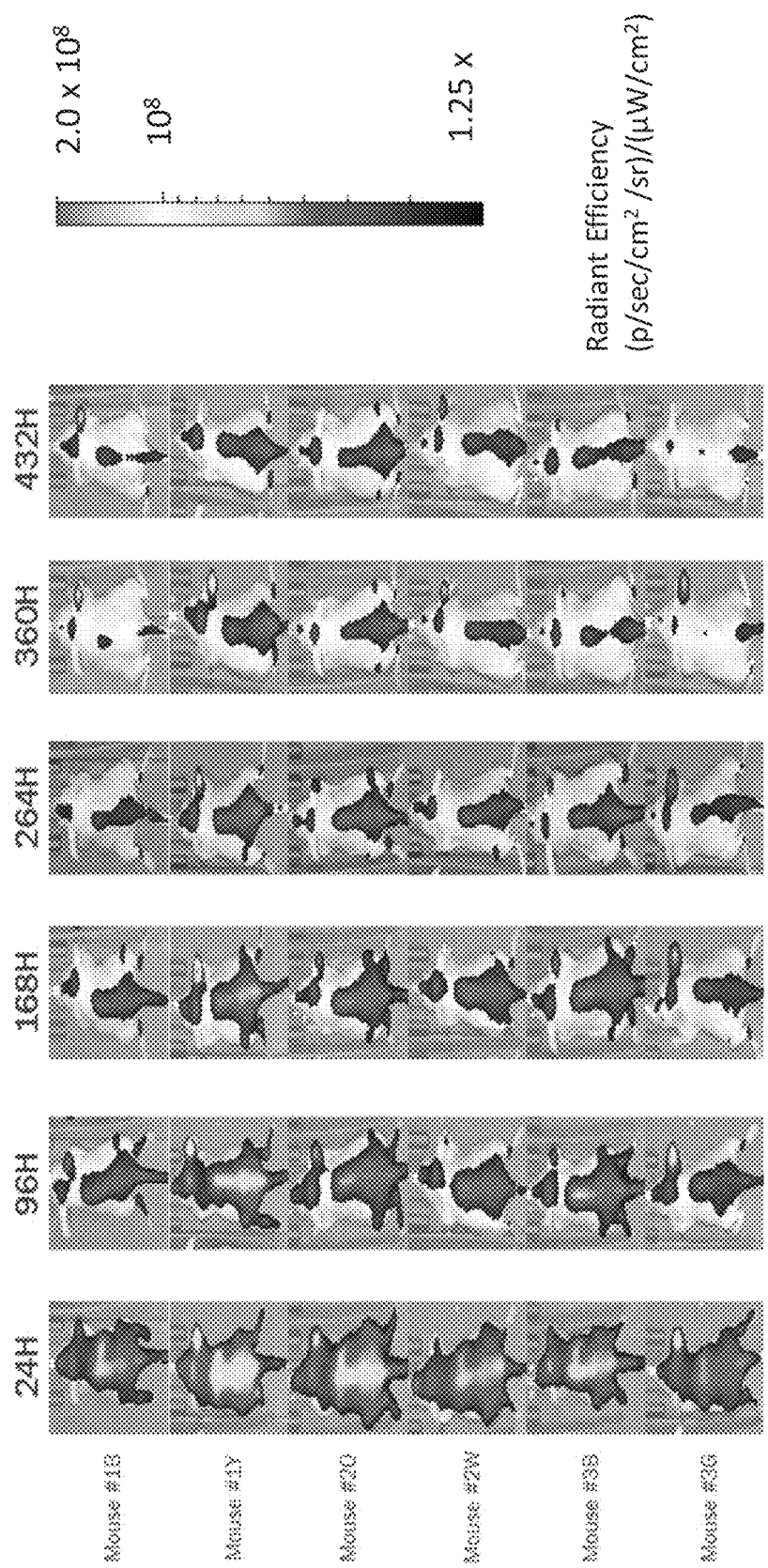
FIG. 12 is a series of two-dimensional IVIS images of mice treated with the ALP-Fc-D10, ALP031 (SEQ ID NO: 31) (Example 8, N=6), showing in vivo bone binding overtime.
Figure 13:
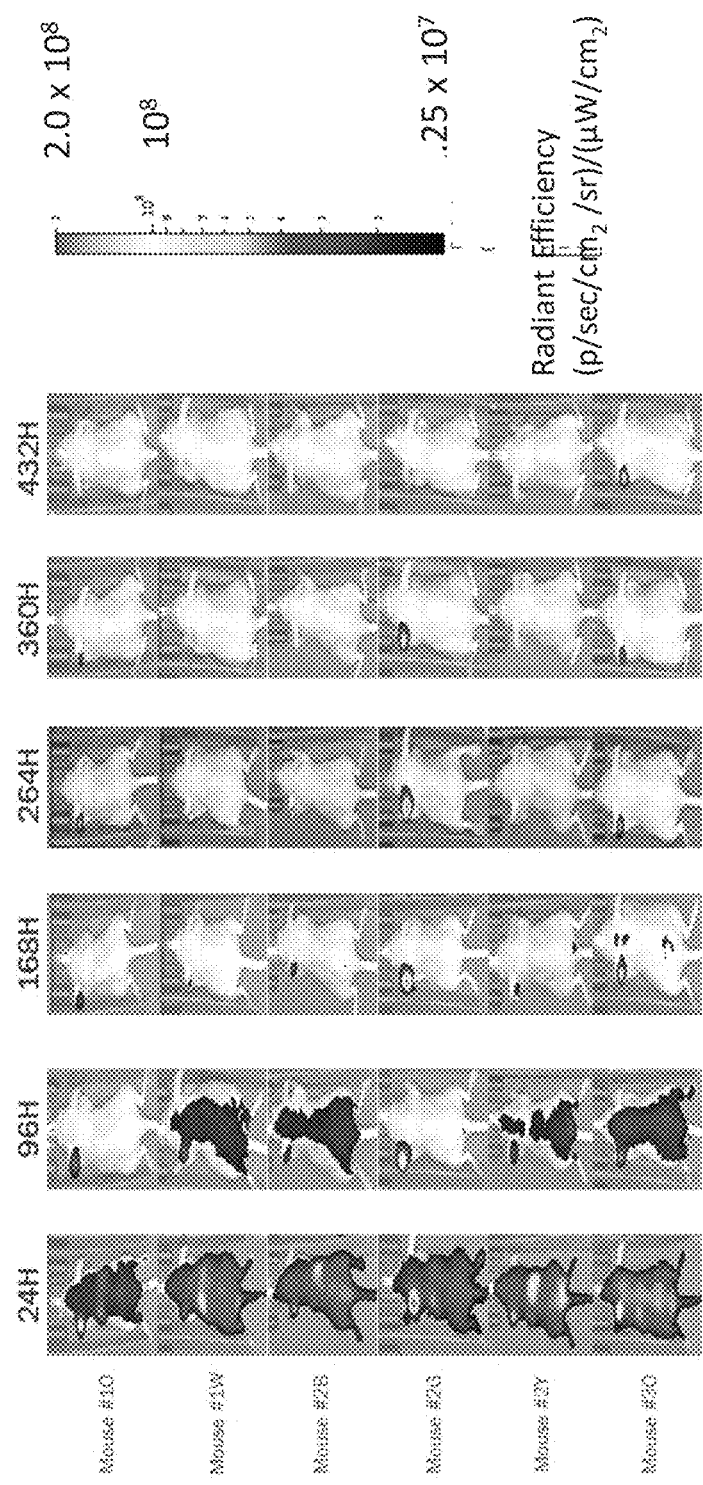
FIG. 13 is a series of two-dimensional IVIS images of the mice treated with ALP-Fc fusion protein, no tag, ALP086, Example 8, N=6, showing in vivo bone binding over time.

MUP activity of the bound and unbound fractions of 17 constructs was measured via the initial activity slope in the first 5 minutes to preserve linearity. The ratio of MUP activity was determined for each fusion protein, as ratio= (activity bound)/(activity unbound), with results shown in Table 5 and FIG. 14. Exemplary progress curves from the MUP hydrolysis assay carried out on bone homogenate with various constructs are shown in FIG. 11, and the binding activity is tabulated in Table 5. MUP activity in Table 5 were quantified as follows: <0.2 (−); 0.2 to 0.49 (+); 0.5 to 5.0 (++); >5.0 (+++).

TABLE 5

Binding to Bone Homogenate

| Construct | Binding to Bone Homogenate - Bound/Unbound Ratio |
| --- | --- |
| ALP230 | − |
| ALP231 | + |
| ALP233 | ++ |
| ALP234 | ++ |
| ALP235 | ++ |
| ALP236 | +++ |
| ALP237 | +++ |
| ALP238 | − |
| ALP239 | + |
| ALP242 | +++ |
| ALP243 | + |
| ALP247 | − |
| ALP248 | − |
| ALP250 | + |
| ALP251 | + |

TABLE 5-continued

Binding to Bone Homogenate

| Construct | Binding to Bone Homogenate - Bound/Unbound Ratio |
|---|---|
| ALP253 | + |
| ALP254 | +++ |

The ratio of MUP activity was determined for each fusion protein, as ratio = (activity bound)/(activity unbound).
Legend:
<0.2 (−);
0.2 to 0.49 (+);
0.5 to 5.0 (++);
>5.0 (+++)

Example 3

Activity of Alkaline Phosphatase Constructs Against Natural Substrates

Improved properties of the protein fusion molecules described herein were verified in different enzymatic assays, measuring hydrolysis of natural and artificial substrates. Artificial substrates used in activity assays included 4-MUP and para-nitrophenyl phosphate (pNPP). Natural substrates used in activity assays included pyrophosphate (PPi) and pyridoxyl-5'-phosphate (PLP). Changes in activity over wild-type ALP ranged from negative (decreased enzymatic activity) to increases of enzymatic activity of up to 9.5 fold (850% activity increase).

Pyrophosphate Hydrolysis Assay.

Certain purified alkaline phosphatase fusion proteins were assayed for activity against the natural substrate pyrophosphate. Pyrophosphate hydrolylsis was measured by detection of the product, phosphate anion, using PiBlue assay reagent (BioAssay Systems) which turns bright green upon binding of phosphate. Quantitation of phosphate levels in each well was performed using a standard curve of phosphate solutions made in assay buffer that was read on the assay plate. Sodium pyrophosphate decahydrate (Sigma Chemicals) stock solutions were prepared in pure water at a concentration of 10 mM. Purified fusion protein samples were prepared as 0.1 mg/mL solutions in assay buffer [50 mM HEPES pH 7.4, 150 mM NaCl, 1 mM MgCl2, 1 mg/mL bovine serum albumin], and serially diluted to an appropriate final concentration for assay in assay buffer. Pyrophosphate samples for assay were prepared by dilution of the stock solution in assay buffer. All solutions were brought to 37° C. prior to initiation of the reaction. Protein solutions were added to clear 96-well plates, and the plates were placed in a Jitterbug plate shaker held at 37° C. Initiation of the reaction was performed by addition of the pyrophosphate solutions to the protein solution.

Typically, the pyrophosphate hydrolysis reaction was performed at pyrophosphate concentrations of 0 uM, 1.56 uM, 3.12 uM, 6.25 uM, 12.5 uM, 25 uM, 50 uM, 100 uM, 200 uM, and 400 uM simultaneously in the same plate. Eight reaction wells were set up at each pyrophosphate concentration, and the reaction was stopped by addition of PiBlue reagent (added at an equal volume as the final reaction volume) after 0, 1, 2, 3, 4, 5, 6, and 7 minutes had elapsed after addition of pyrophosphate to the plate. Addition of PiBlue reagent stops any further reaction because the low pH of the detection reagent inactivates the enzyme. Color is allowed to develop in the plate for 30 minutes prior to being read for absorbance at 620 nm. Rates of reaction at each pyrophosphate concentration are calculated by constructing progress curves from the individual time points. Rates of reaction at each concentration were used to calculate Km and Vmax values in GraphPad Prism, using a Michaelis-Menten enzyme kinetic fit. kcat values were calculated from Vmax values by:

Vmax/(moles protein assayed)=kcat.

Catalytic efficiencies is defined as: Catalytic efficiency=kcat/Km.

Figure 22:
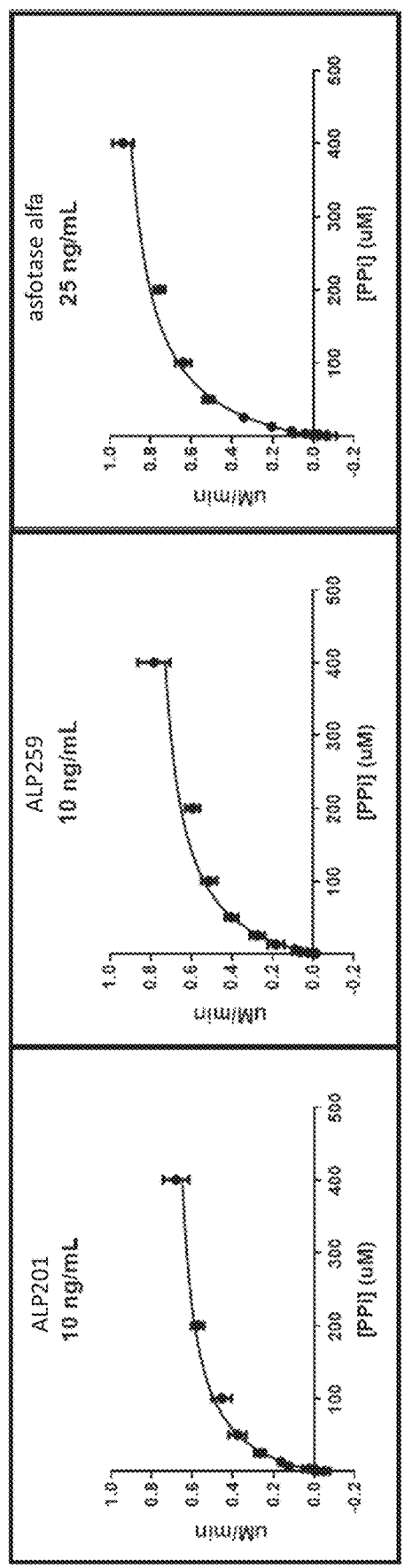
FIG. 22 is a set of graphs showing saturation curves showing the relationship of increasing pyrophosphate (PPi) levels with rate of pyrophosphate hydrolysis by selected constructs with rate of reaction plotted versus pyrophosphate concentration for ALP201, ALP259, and asfotase alfa (SEQ ID NO: 269).

Michaelis-Menten plots detailing pyrophosphate hydrolysis activity of selected compounds is shown in FIG. 22. ALP201 at 10 ng/mL, ALP250 at 10 ng/mL, and asfotase alfa (SEQ ID NO: 269) at 25 ng/mL are all shown. Standard deviation is shown (bars), N=3.

TABLE 6

Pyrophosphate hydrolysis parameters for tested alkaline phosphatase fusion proteins

| Construct | kcat (s$^{-1}$) | Catalytic efficiency (M$^{-1}$ s$^{-1}$) |
|---|---|---|
| ALP001 | + | + |
| ALP004 | + | − |
| ALP023 | + | + |
| ALP031 | ++ | − |
| ALP035 | ++ | +++ |
| ALP039 | ++ | +++ |
| ALP042 | + | − |
| ALP043 | ++ | + |
| ALP044 | + | + |
| ALP133 | +++ | ++ |
| ALP137 | +++ | ++ |
| ALP138 | +++ | +++ |
| ALP139 | +++ | +++ |
| ALP142 | ++ | + |
| ALP143 | +++ | ++ |
| ALP171 | ++ | + |
| ALP173 | ++ | + |
| ALP174 | ++ | − |
| ALP179 | ++ | − |
| ALP182 | ++ | − |
| ALP184 | − | − |
| ALP201 | +++ | +++ |
| ALP202 | +++ | +++ |
| ALP203 | +++ | ++ |
| ALP206 | + | + |
| ALP207 | ++ | + |
| ALP208 | ++ | − |
| ALP209 | ++ | + |
| ALP211 | ++ | + |
| ALP212 | ++ | − |
| ALP213 | ++ | + |
| ALP214 | ++ | + |
| ALP215 | ++ | + |
| ALP219 | + | + |
| ALP225 | ++ | − |
| ALP226 | ++ | + |
| ALP259 | +++ | + |

For kcat parameter:
(+++) >130 s−1,
(++): 130-65 s−1,
(+): 65-33 s−1,
(−) <33 s−1

For catalytic efficiency parameter:
(+++) >20 * 10ˆ6 M−1 s−1,
(++): 20 * 10ˆ6-6 * 10ˆ6 M−1 s−1,
(+): 6 * 10ˆ6-3*10ˆ6 M−1 s−1,
(−) <3 *10ˆ6 M−1 s−1

Pyridoxyl-5'-phosphate hydrolysis Assay.

Figure 23:
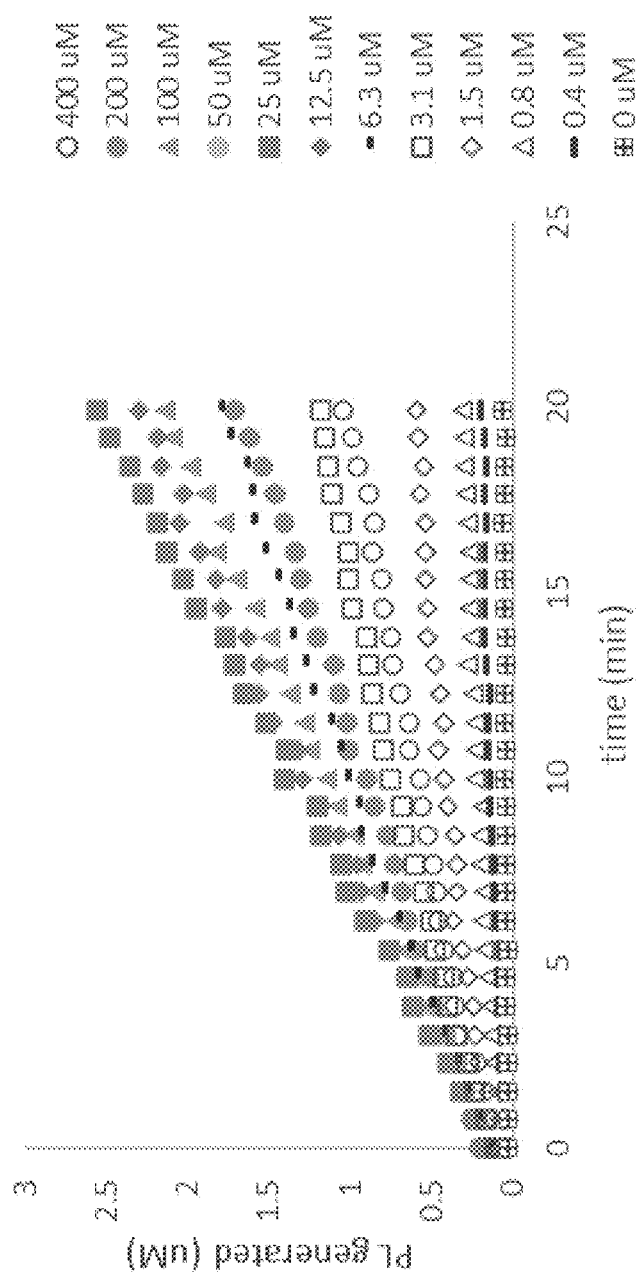
FIG. 23 is a graph showing an exemplary progress curve of an ALP/TPLDH coupled PLP hydrolysis assay, with fluorescence plotted versus time for ALP201 at 10 ng/ml.
Figure 24:
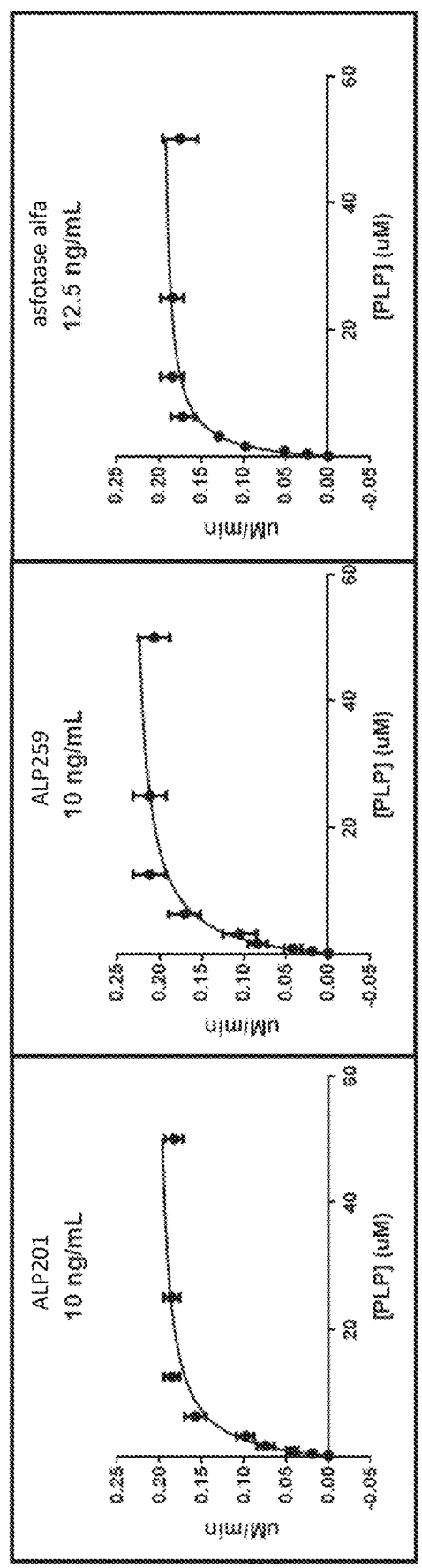
FIG. 24 is a set of graphs showing saturation curves showing the relationship of increasing pyridoxyl-5'phosphate (PLP) levels with rate of PLP hydrolysis by in the ALP/TPLDH coupled assay by selected constructs (ALP201, ALP259, and asfotase alfa; 10 ng/mL, 10 ng/mL, and 12.5 ng/mL, respectively) with rate of reaction plotted versus PLP concentration in uM.

A second natural substrate of alkaline phosphatase is pyridoxyl-5'phosphate (PLP). Certain purified alkaline phosphatase fusion proteins were assayed for activity against PLP in a coupled assay format, in which pyridoxyl, the product of PLP hydrolysis, is converted to the fluorescent pyridoxolactone, by *M. loti* tetrametric pyridoxyl dehydrogenase (tPLDH, SEQ ID NO: 246). The gene for 6×His-tagged tPLDH was synthesized by standard methods and cloned into a bacterial expression plasmid under control of the T7 promoter. 6×His-tagged tPLDH was expressed in BL21(DE3) cells using standard protocols and purified by standard affinity chromatography methods. The protein was concentrated to a concentration of 1900 uM using an Amicon Ultra15 Spin concentrator and frozen at −80° C. until used in the assay. Purified fusion protein samples were prepared as 0.1 mg/mL solutions in assay buffer [50 mM HEPES pH 7.4, 150 mM NaCl, 1 mM $MgCl_2$, 1 mg/mL bovine serum albumin]. Final serially diluted samples are placed in a black 96-well plate, along with pyridoxolactone standards (made in assay buffer). To the protein samples, $NAD^+$, tPLDH, and PLP solutions (made in assay buffer) are added in order to final concentrations of 3 mM NAD+, 4 uM tPLDH, and 3 uM PLP and mixed. All solutions are brought to 37° C. prior to initiation of the reaction, and the reaction plate is incubated at 37° C., and fluorescence detected by excitation at 355 nm and emission measured at 445 nm. Amount of pyridoxolactone product generated is calculated using a standard curve generated from measured fluorescence from the pyridoxolactone wells in the plate. Rates of reaction are calculated by linear regression of the progress curves in units of umoles pyridoxyl produced/min. Specific activities are calculated by dividing rates of reaction by the protein concentration used in the assay reaction. An exemplary progress curve of data generated by this assay is shown in FIG. 23 for ALP201, 10 ng/mL. Michaelis-Menten plots detailing pyridoxal-5'-phosphate hydrolysis activity of ALP201 at 10 ng/mL, ALP250 at 10 ng/mL, and asfotase alfa at 12.5 ng/mL are shown in FIG. 24.

TABLE 7

Measured PLP Hydrolysis activity of
Alkaline Phosphatase Fusion Proteins

| Construct | Specific Activity in PLP Hydrolysis Assay (umol/min/mg) |
|---|---|
| ALP001 | + |
| ALP023 | − |
| ALP039 | + |
| ALP138 | − |
| ALP139 | + |
| ALP200 | + |
| ALP201 | + |
| ALP203 | − |
| ALP043 | + |
| ALP173 | ++ |
| ALP174 | + |
| ALP0213 | ++ |
| ALP0214 | ++ |
| ALP0215 | + |
| ALP0219 | + |

Legend:
Activity <1 umol/min/mg (−),
1-2 umol/min/mg (+),
>2 umol/min/mg (++)

Example 4

Hydroxyapatite Binding Assay
Characterization of Fluorescent Fc-Fusion Binding to Hydroxyapatite (HA).

Synthetic HA (CAPTAL®) was purchased from Plasma-Biotal Ltd. (Derbyshire, UK). In separate 1.5 mL centrifuge tubes, bone targeting fluorescent Fc-fusions were diluted to 50 nM in 0.1% (w/w) bovine serum albumin (BSA) in phosphate buffered saline (PBS) pH 7.4 (1 mL suspension per tube). To each fluorescent Fc-fusion-containing tube, 1 mg synthetic HA was added, and tubes were incubated at room temperature for 2 hours with orbital mixing to prevent HA from settling. After incubation, samples were centrifuged at 16,000 rcf for 5 minutes to separate the solid HA-bound fraction from the unbound protein suspension. HA-bound fractions were subsequently washed three times with PBS, and the final HA fraction was suspended in 100 μL PBS. Suspended HA-bound fractions and 100 μL unbound protein suspensions were transferred to 96-well black plates (1 fraction per well), and relative protein concentrations were determined by fluorescent excitation/emission at 488 nm/585 nm using a fluorescent plate reader (Spectramax i3x).

Figure 1B:
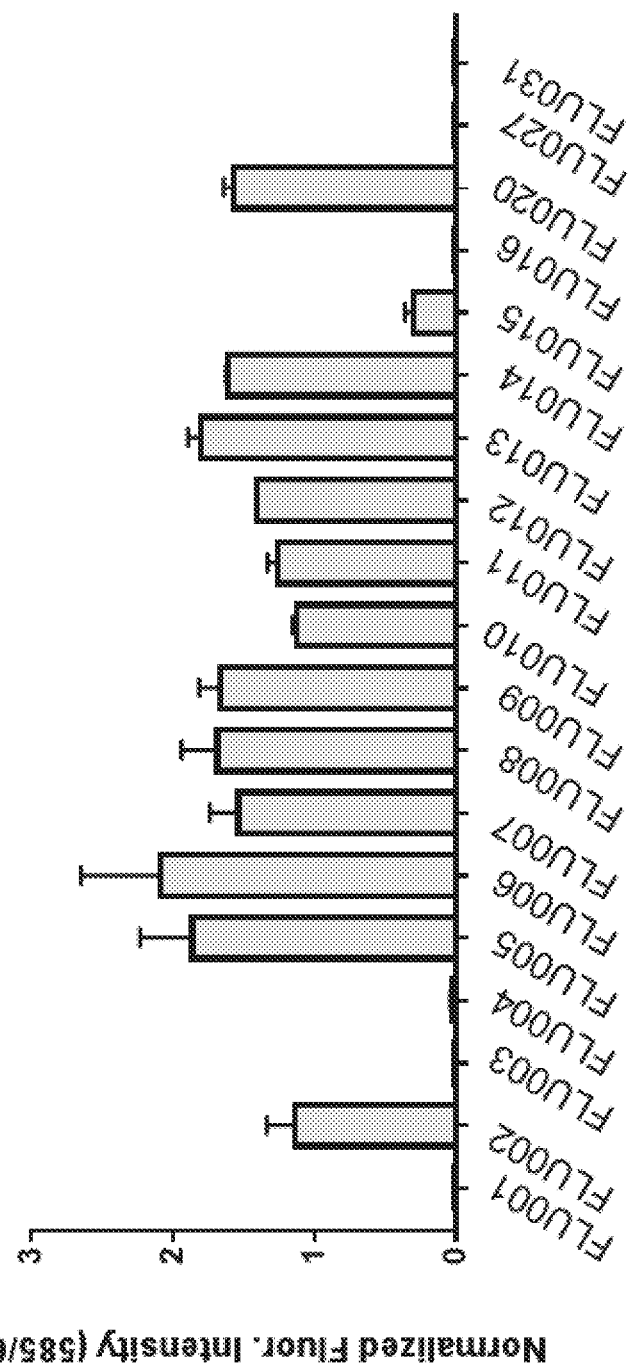

Twenty fluorescent Fc-fusion proteins were transiently expressed in HEK cells and purified using Ni-NTA resin (see Table 1 for sequence details). Fluorescent Fc-fusion proteins differed only in N-terminal HA-binding sequences to systematically evaluate bone targeting moieties in vitro. In separate tubes, fluorescent Fc-fusion proteins were incubated in suspension with HA in the presence of BSA to prevent nonspecific binding. FIG. 1A shows the fluorescence intensity of the HA-bound fraction for each fluorescent Fc-fusion sample relative to untargeted fluorescent Fc-fusion (FLU002). In addition, unbound protein fractions were collected immediately after incubation with HA (prior to the first wash of HA pellets). These fluorescence intensities are also plotted in relation to FLU002, shown in FIG. 1B. For FLU001, 003, 004, 016, 027, and 031, 100% of the protein bound to HA, as none of these proteins were detected above background in the unbound protein fractions. Conversely, FLU002 showed 4-fold less binding to HA compared to FLU001, and significant unbound fluorescent signal (100-fold greater than FLU001 or background). FLU005-009, 011-014, and 020 showed HA binding characteristics similar to FLU002. Interestingly, two proteins (FLU010 and FLU015) showed significant fluorescence (above the negative control) in the HA bound fraction as well as in the unbound fraction.

Hydroxyapatite (HA) has been used interchangeably for bone as a binding substrate for in vitro bone targeting assays, however, significant differences between ceramic HA and natural bone have been noted, especially with respect to the role of collagen and other extracellular matrix proteins on controlled crystal nucleation in vivo (Zhai, Y., et al., *J. Crystal Growth*, 202-206, 2006). CAPTAL® brand HA was specifically used in this study because it was manufactured to be a bone mineral analog based on its $Ca:PO_4$ ratio (1.67), iron content (100 ppm), magnesium content (800-1100 ppm), and crystal lattice. Still, significant differences in total protein binding were observed between CAPTAL® HA and bone homogenate. Most importantly, nonspecific binding was observed for all fluorescent Fc-fusion proteins incubated with HA, even in the presence of BSA blocking agent. When incubated with bone homogenate, untargeted fluorescent Fc-fusion control proteins (FLU002) showed no fluorescent signal above background (bone homogenate alone). Thus, bone homogenate was a more stringent binding substrate compared to HA, which behaved more like a typical ion exchange resin. However, when normalized to a proper control protein (as in FIGS. 1A-1D), HA binding data was useful in identifying efficient bone binding proteins, although the dynamic range for fluorescent Fc-fusion protein detection was much depleted in HA binding assays (by approximately 5-fold). ALP-Fc proteins showed even greater non-specific binding to HA, most likely due to the negative charge of the ALP catalytic domain. In some cases, this even led to false identification of some ALP-Fc-X proteins as having HA-binding properties, which was not observed when incubated with bone homogenate. Because of this, bone homogenate was deemed a superior substrate for screening bone binding proteins, and was used for all subsequent in vitro assays.

Example 5

Bone Homogenate Assay

Previous literature assays relied on bone slices or other three-dimensionally physically restrained substrates. A more accurate, faster, and more efficient assay was needed to distinguish and quantify protein efficacy and to quantify binding percentages.

Preparation of Bone Homogenate.

Femurs from male C57BL/6 mice were stored at −80° C. prior to use. Femurs were transferred to 2 mL centrifuge tubes (2 femurs per tube) with 1 mL 0.2% (w/w) collagenase type 2 (Worthington) in BS with 1×EDTA-free serine and cysteine proteases inhibitor cocktail (COMPLETE™, Roche). Femurs were briefly vortexed and incubated at 37° C. with shaking (800 rpm) for 1 hour. Remaining connective tissue was removed, and femurs were placed on petri dishes on ice. Bone marrow was flushed with PBS using needle and syringe. Dry bone was massed (typically 30-50 mg per femur) and placed in pre-chilled hard tissue grinding individual disposable beat beaters (PRECELLYS®, Bertin Instruments) with 0.75 mL PBS with 1× protease inhibitor. Femurs were then homogenized using a high-throughput bead mill homogenizer (Bullet Blender, 4° C., max speed, 4 cycles of 30 second duration). Homogenate was transferred to 1.5 mL centrifuge tubes and centrifuged at 12,000×g for 15 minutes at 4° C. to separate bone homogenate from released protein/cell debris. Bone homogenate was resuspended in 0.1% BSA in PBS for use in binding assays.

Fluorescent Fc-Fusion Binding to Bone Homogenate In Vitro.

Fluorescent Fc-fusion proteins were diluted to 50 nM in PBS with 0.1% BSA and incubated with 3 mg bone homogenate in individual 1.5 mL centrifuge tubes (1 mL per tube). Samples were mixed at room temperature for 2 hours before bone homogenate bound and unbound fractions were separated via centrifugation. Bone homogenate fractions were washed 3 times with PBS, and final homogenate pellet was suspended in 100 μL PBS. Suspended bone homogenate and 100 μL unbound protein suspensions were quantified for relative fluorescent Fc-fusion concentration using a fluorescent plate reader.

Figure 1C:
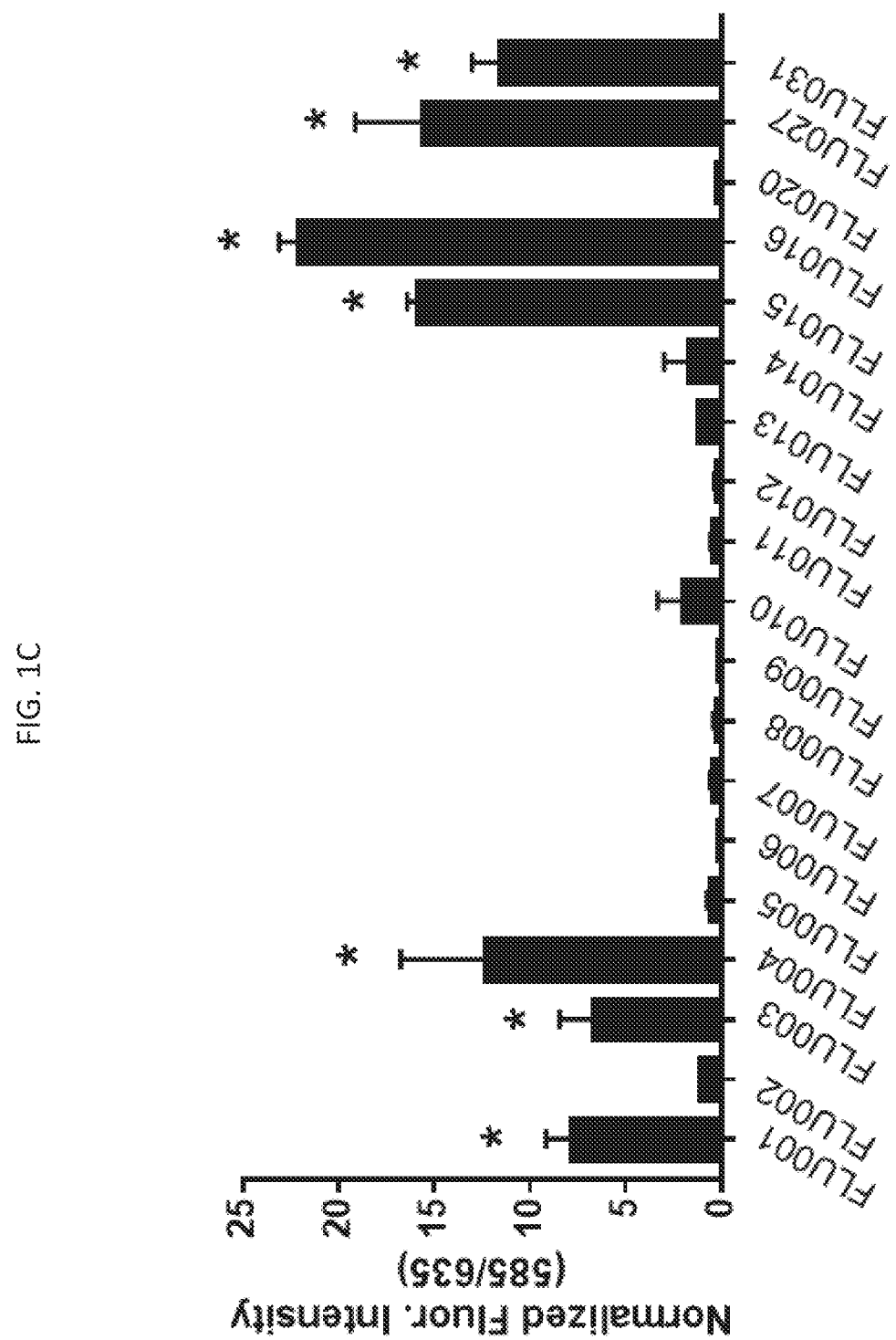

For all fluorescent Fc-fusion proteins, binding to bone homogenate followed similar trends as binding to HA, however, there was a greater numerical difference between efficient bone binding proteins (e.g., FLU001) and nonbinders (e.g. FLU002), as shown in FIG. 1C. In the bone bound fractions, an 8-fold increase in fluorescence was observed for FLU001 over the negative control (FLU002), compared to the 4-fold increase observed in binding to HA. FLU010 binding to bone homogenate was not significantly above the negative control (FLU002), however, FLU015 still showed efficient binding to bone homogenate, with a significant presence in the unbound fraction. To ensure these results were not a statistical anomaly, the experiment was repeated with n=4, and the same outcome was observed for FLU010 and 015.

Figure 2A:
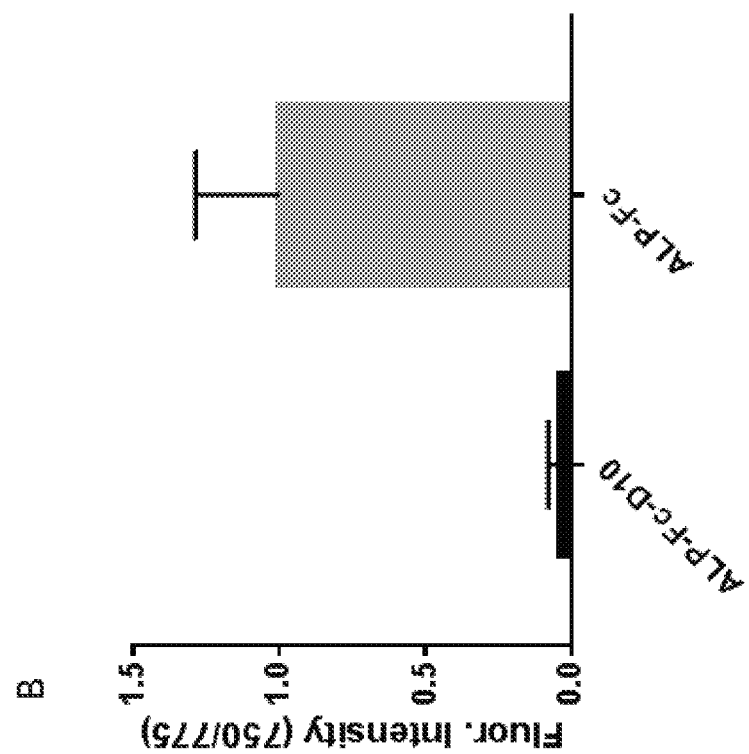
FIGS. 2A-2B are graphs showing bone targeted (ALP-Fc-$D_{10}$) (ALP031; SEQ ID NO: 31) and untargeted (ALP-Fc) (ALP086; SEQ ID NO: 222) fusion binding to mouse bone homogenate measured via fluorescent probe. Fluorescent intensities of bone homogenate bound (FIG. 2A) and unbound (FIG. 2B) protein fractions were normalized to the untargeted negative control (ALP-Fc). N=3±SD.
Figure 2B:
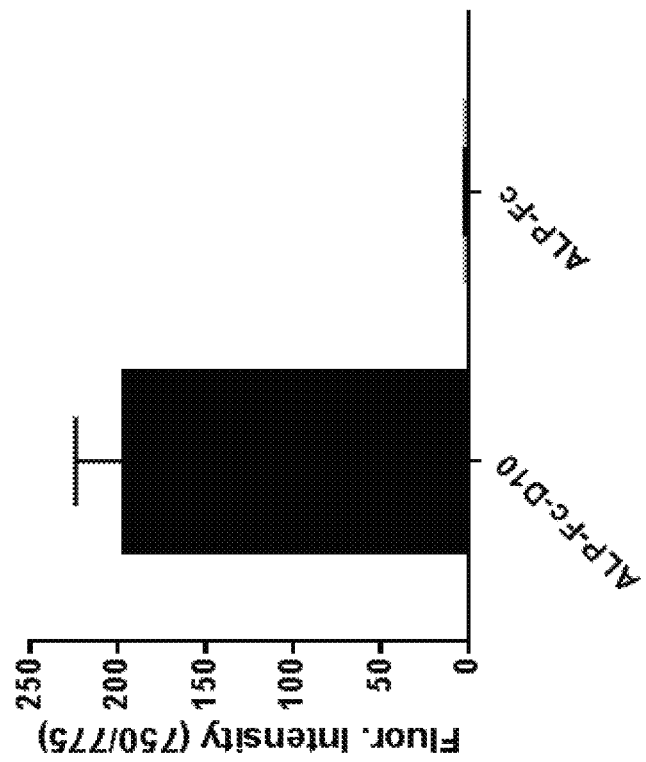

Importantly, raw fluorescence data quantifying the total amount of protein bound to HA (Example 2) and bone homogenate showed significantly greater binding of untargeted proteins to an equivalent mass of HA compared to bone homogenate (in some cases as much as 75-fold increase in binding to HA), indicating some nonspecific binding of proteins to HA even in the absence of efficient bone targeting moieties. Nonspecific binding to HA was further exacerbated when blocking agent was removed from protein incubations, showing the ability of HA to bind a variety of proteins, including those without specific HA binding moieties. Although HA was less useful in distinguishing moderate HA-binding fusions from untargeted fusions, HA was a suitable substrate for determining highly efficient bone binding proteins. Because bone homogenate was a more stringent binding substrate, and did not show any nonspecific binding of untargeted proteins (see FIG. 1), all subsequent bone binding screening assays were performed using murine bone homogenate as the binding substrate (FIGS. 2A-2B).

Figure 3B:
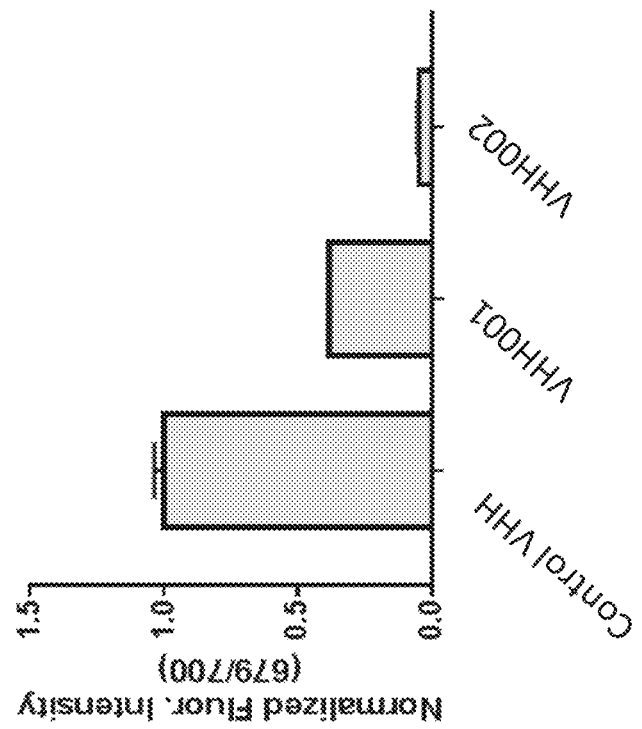
FIGS. 3A-3B are graphs showing fluorescently labeled VHH protein binding to mouse bone homogenate. Fluorescent intensities of bone homogenate bound (FIG. 3A) and unbound (FIG. 3B) protein fractions were normalized to the untargeted negative control VHH. N=3±SD.
Figure 3A:
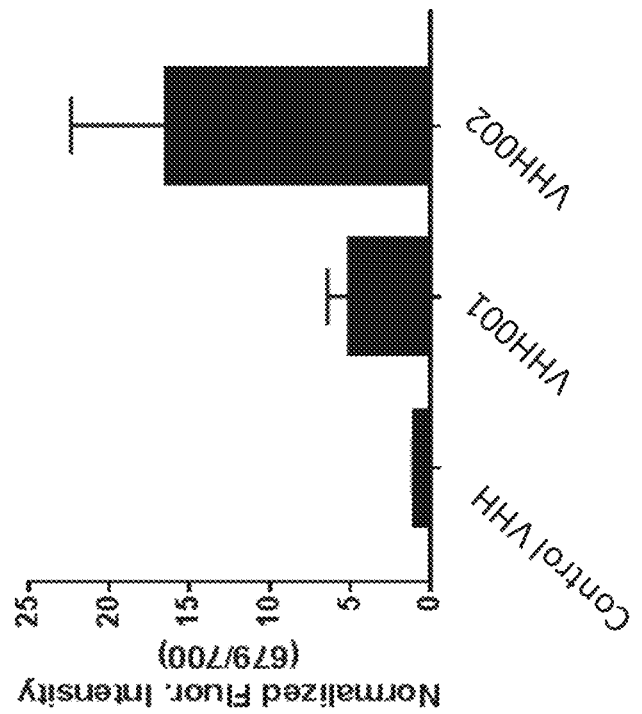

Fluorescence intensities for bound and unbound fractions were normalized to untargeted fluorescent Fc-fusion proteins to compare between different targeting moieties (FIGS. 3A-3B). In vitro binding experiments were performed in duplicate±standard deviation.

Characterization of Construct Binding to Bone Homogenate.

An in vitro model was used to characterize bone binding of ERT-like molecules prior to in vivo dosing. To utilize the hydroxyapatite fluorescent based binding assay, ALP031 (ALP-Fc-D10) and ALP086 (ALP-Fc) proteins were fluorescently labeled with commercially available antibody labeling kits (Invitrogen/ThermoFisher). Alexa Fluor dyes were previously activated with succinimidyl esters or tetrafluorphenyl esters that react with primary amines on proteins. Therefore, fluorescent labeling was not site-directed, and the degree of labeling was between 3-5 moles fluorophore per mole of antibody. Once labeled and purified to remove free dye, 30 nM protein solutions were made in 0.1% BSA, and bone homogenate binding assays were performed as described as above for FFC constructs. Exemplary data for constructs with varying affinities for bone homogenate are shown in FIG. 1C, FIG. 1D, FIG. 2 and FIG. 3.

Plate Bone ALP Activity Assay

Bone homogenate fractions were assayed for ALP activity using 4-MUP. The bone homogenate fractions were suspended in 100 μL PBS and transferred to 96-well black plates. 100 μL unbound protein suspensions were also transferred to separate wells of the 96-well plate. To each well, 100 μL of ALP detection solution (10 μM 4-MUP, 1% BSA) was added and kinetic fluorescent reading (at 360/465) was immediately initiated and run for 20 minutes, with fluorescent intensity emissions collected every 30 seconds. The slope of fluorescence intensity vs. time represented ALP concentration in each sample fraction.

MUP activity of the bound and unbound fractions of multiple constructs was measured via the initial activity slope in the first 5 minutes to preserve linearity. The ratio of MUP activity was determined for each fusion protein, as ratio=(activity bound)/(activity unbound), with results shown in FIG. 14. This ratio demonstrates an exponential response with increasing length of the poly-acidic bone targeting tag, leading to significantly stronger bone homogenate binding as individual residues are added to the poly-acidic peptide.

Determination of Relative Protein Affinity for Bone Homogenate In Vitro

A multi-dose assay was developed to rank the relative affinity of bone binding proteins. For proteins that efficiently bound bone homogenate, relative dissociation rates were determined by this kinetic protein-on-bone exchange assay.

Proteins were assessed individually (e.g., one protein type per tube), by incubating saturating concentrations (1 µM) of unlabeled bone binding protein with 5 mg bone homogenate in 1.5 mL Eppendorf tubes. After 24 hr incubations with unlabeled protein, bone homogenate was centrifuged (16,000 rcf, 5 minutes) to remove excess unbound protein. Bone homogenate, saturated with a given bone binding protein, was resuspended in 0.5 µM solutions of the same bone binding protein labeled with an ALEXA FLUOR® fluorescent probe and allowed to incubate for 1, 2, 4, 8, and 24 hrs before bone homogenate was centrifuged, washed 3× with PBS, and transferred to a 96-well black plate. The supernatant from the first centrifugation was also collected to quantify the amount of fluorescent protein that remained in suspension (unbound). A fluorescent plate reader was used to quantify the amount of bound and unbound fluorescently-labeled protein at each time point, which allowed for a kinetic representation of the unlabeled protein dissociation rate.

Bone homogenate was initially saturated with a given protein for 24 hours, washed thoroughly to remove excess unlabeled protein, and finally incubated with the same protein containing a fluorescent label to follow the exchange of the protein saturating the surface of bone homogenate with soluble (fluorescently labeled) protein. Fluorescent signal was normalized to samples that were not pretreated for 24 hours with a saturating concentration of unlabeled protein, representing the maximum potential binding for fluorescently labeled proteins. VHH001 (circles) showed immediate equilibration of bound and unbound protein concentrations indicating a rapid exchange rate or low affinity bone homogenate binder. VHH002 (squares) showed more gradual displacement of bound protein with fluorescently labeled protein in solution. ALP031 (triangles) showed minimal displacement of bound protein with fluorescently labeled protein, which indicated a high affinity for bone once bound.

Figure 10A:
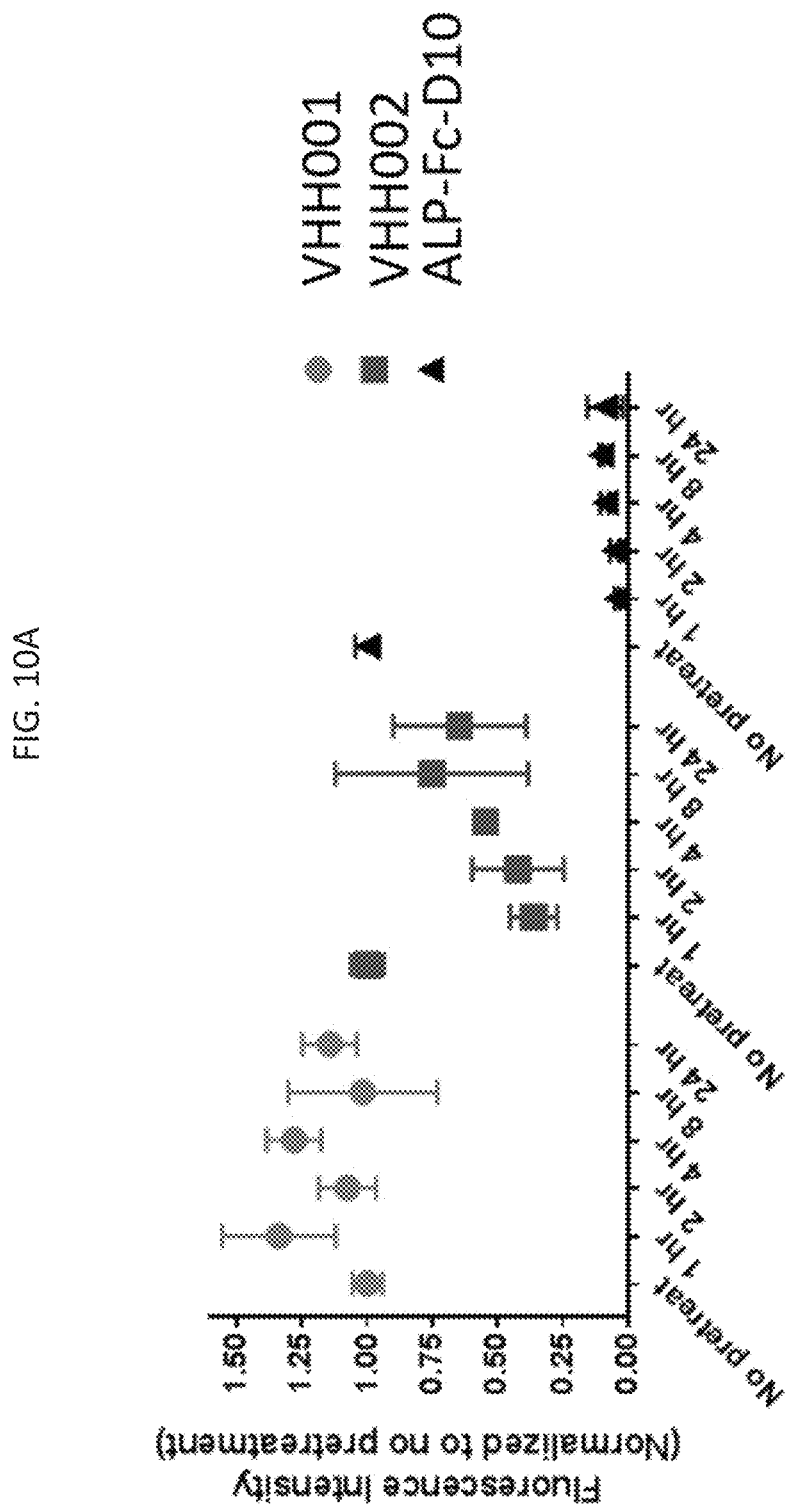
FIGS. 10A-10B are graphs showing multi-dose binding and dissociation of bone targeting proteins in vitro.
Figure 10B:
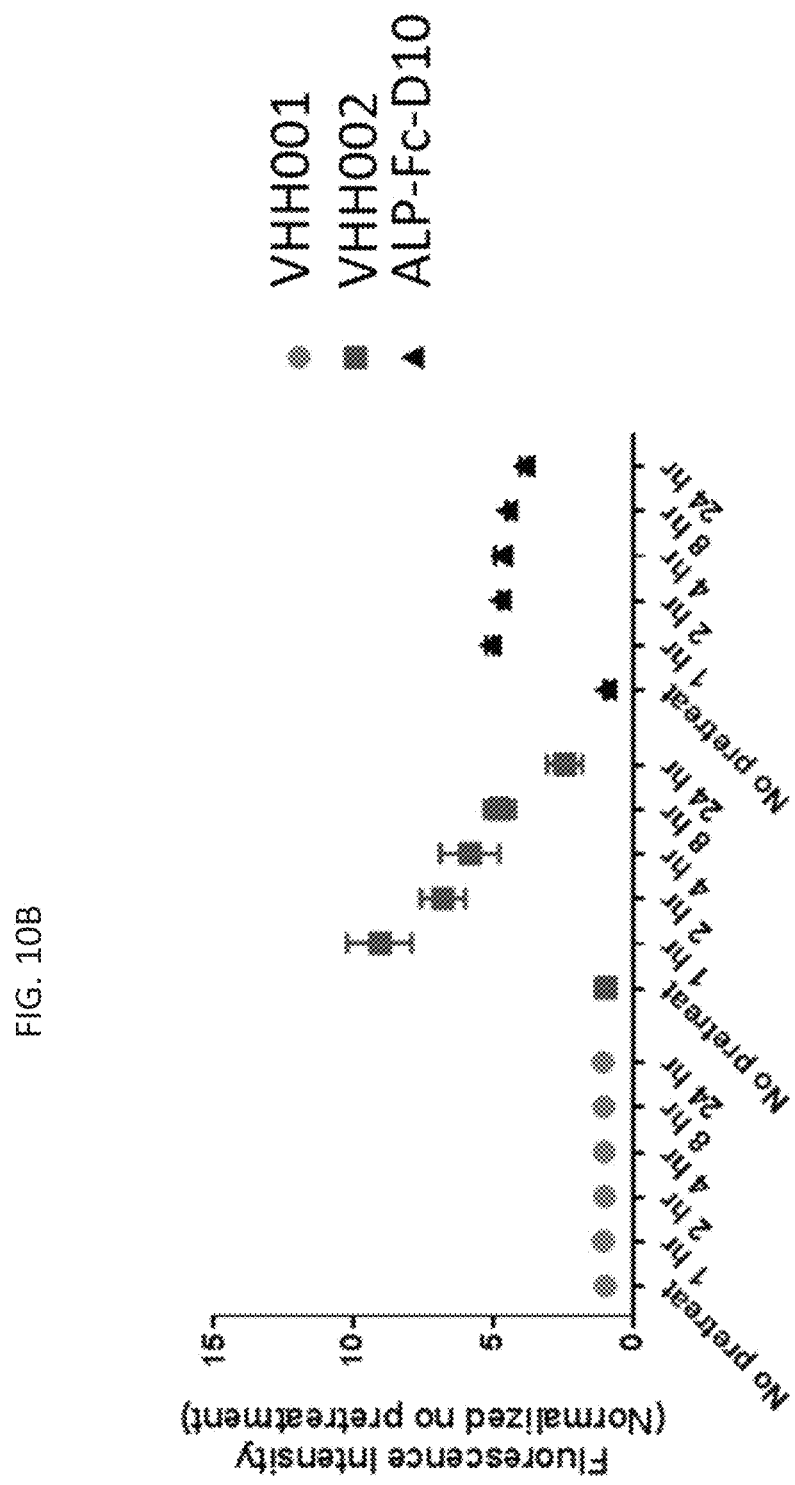

Kinetic curves of fluorescent protein accumulation on pre-saturated bone showed replacement of unlabeled protein on bone for labeled protein (FIGS. 10A-10B).

Characterization of ALP-Fc-(Asp)$_{10}$ and ALP-Fc Binding to Bone Homogenate.

An in vitro model was used to characterize bone binding of ERT-like molecules prior to in vivo dosing. To utilize the hydroxyapatite fluorescent based binding assay, ALP-Fc-(Asp)$_{10}$ and ALP-Fc fusion proteins were fluorescently labeled with commercially available antibody labeling kits (Invitrogen/ThermoFisher). ALEXA FLUOR® dyes were previously activated with succinimidyl esters or tetrafluorphenyl esters that react with primary amines on proteins. Therefore, fluorescent labeling was not site-directed, and the degree of labeling was between 3-5 moles fluorophore per mole of antibody. Once labeled and purified to remove free dye, 30 nM protein solutions were made in 0.1% BSA, and bone homogenate binding assays were performed as described.

Fractions bound/unbound varied according to an approximate Gaussian distribution as a function of bone tag length.

Results

In vitro characterization of bone homogenate binding was indicative of bone targeting in vivo (see Example 5), yet studying association (binding) alone did not allow for differentiation between two highly efficient bone targeting moieties. For example, both ALP-Fc-D$_{10}$ (SEQ ID NO: 31) and VHH002 (SEQ ID NO: 250) showed quantitative binding to bone homogenate in vitro and efficient binding and retention on bone in vivo. Although these proteins are nearly indistinguishable by these experiments, they possess quite different affinities for bone based on dissociation behavior. As shown in FIGS. 10A-10B, bone bound VHH002 can exchange with excess soluble fluorescently labeled VHH002 in solution. In contrast, ALP-Fc-D$_{10}$ shows almost no dissociation from bone homogenate once bound, even in the presence of excess soluble fluorescently labeled ALP-Fc-D$_{10}$. Therefore, ALP-Fc-D$_{10}$ showed much greater affinity for bone compared to VHH002 despite having nearly equivalent association (binding) rates. VHH002 and ALP-Fc-D$_{10}$ efficiently localized to bone and remained in the bone compartment beyond 7 days, but perhaps the mechanism of their localization was quite different. VHH002 demonstrated the ability to dissociate from bone while ALP-Fc-D$_{10}$ showed a significantly slower dissociation after binding. It is possible that ALP-Fc-D$_{10}$ molecules remain nearer to the site of initial binding, while VHH002 has more mobility to bind and dissociate throughout the bone tissue.

Properly understanding the mechanisms of bone localization and the impact of novel targeting domains on therapeutic efficacy will be of great importance for developing optimally effective enzyme replacement therapy. In addition, tuning the residence time and mobility of therapies on bone can be used to optimize the sALP constructs for use in treatments of disease, such as HPP.

Example 6

Pharmacokinetic Analysis in a Murine Model

Male C57BL/6 mice (Jackson Labs) between 11-12 weeks of age were dosed with a single injection at 4-7 mg/kg, either into tail vein or subcutaneously, with sample proteins at 1 mg/mL in sterile PBS (without calcium or magnesium), and followed for 14-21 days. Two intermediate blood draws and one terminal blood draw (cardiac puncture, $CO_2$ anesthesia) were performed on each mouse and staggered in the cohort (4 mice in each of 4 groups, per molecule and per administration type). Blood samples (100 µL, yielding 50 µL plasma after centrifugation) were collected into Li/heparinized tubes at 0.25, 1, 6, 24, 48, 72, 96, 120, 192, 264, 336, and 480 hours. Blood samples were stored at 4° C. until processed into plasma; subsequently, plasma samples snap frozen in liquid N2 and stored at −80° C.

Figure 15A:
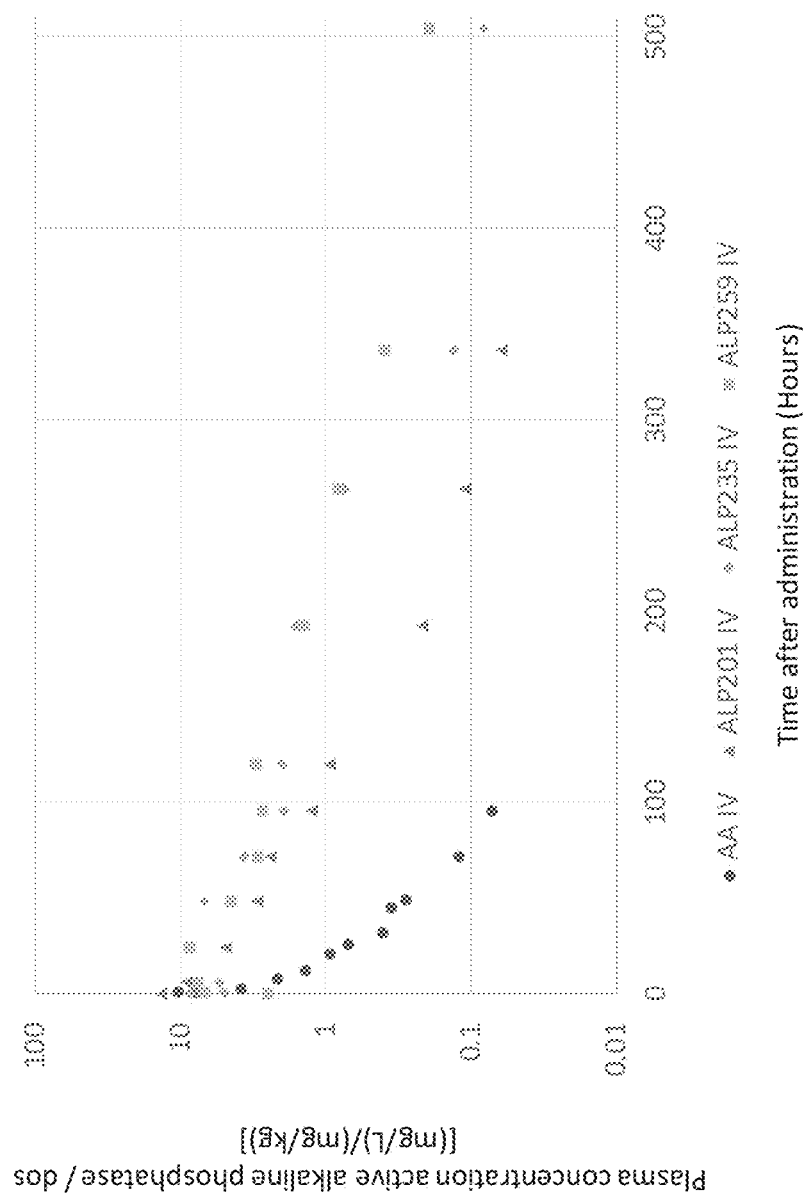
FIGS. 15A-15B are graphs showing pK data showing plasma protein levels in mg/L/dose [(mg/L)/(mg/kg)] vs. hours after dose administration to healthy male C57BL/6 mice via IV route (FIG. 15A) or subcutaneous route (FIG. 15B).
Figure 15B:
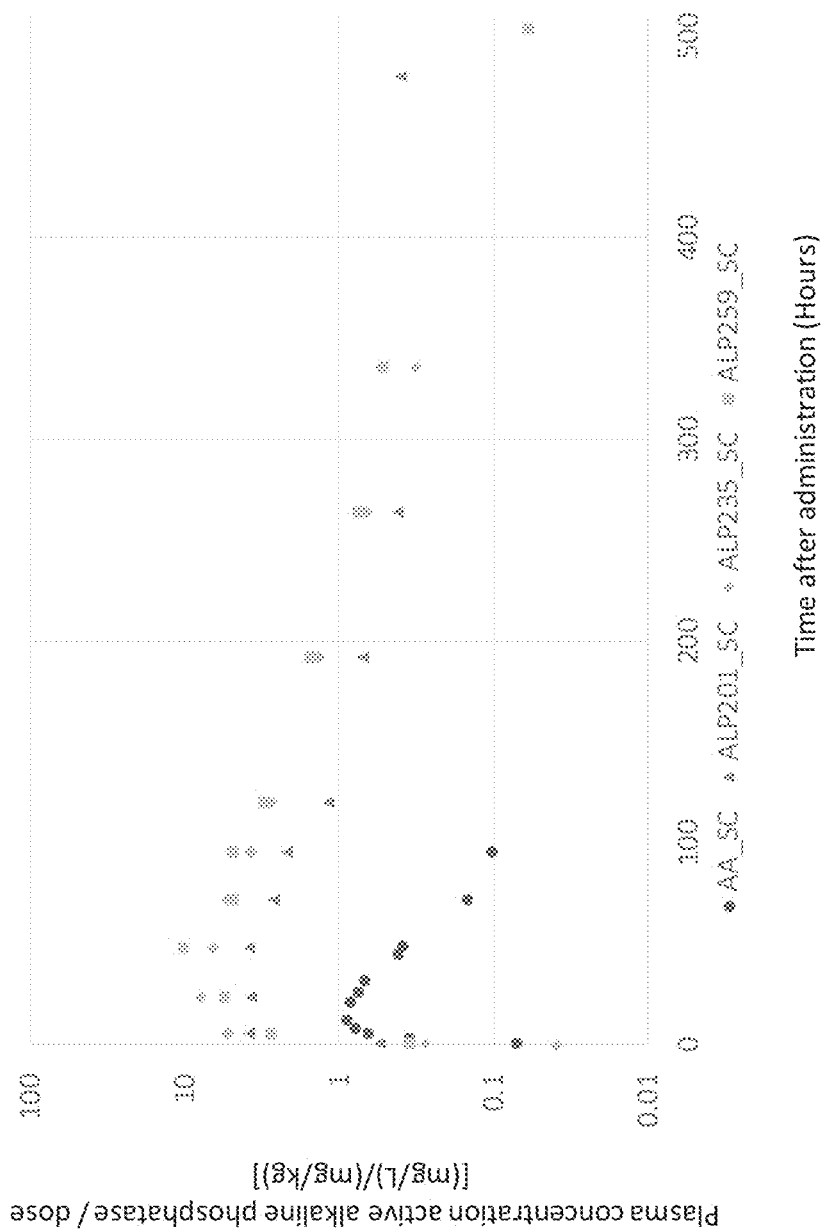

Quantitation of Enzyme Activity in Mouse Plasma Samples:

The 4-MUP assay used in to determine enzyme specific activity in Example 2 was slightly modified to measure activity in collected samples with unknown alkaline phosphatase concentration. Serum samples were diluted 100-fold to 6,000-fold into assay buffer (50 mM HEPES, 150 mM NaCl, 1 mM $MgCl_2$, pH 7.4 and 1 mg/mL BSA) to determine active alkaline phosphatase concentration. The diluted samples were quantitated as described in Example 2, except the standard curve was generated based upon observed activity of a reference standard alkaline phosphatase sample of known activity and concentration. The slope of fluorescence intensity vs. time represented the rate of 4-MU production, which corresponded to ALP activity, in each sample fraction as a function, but here as units/mL serum. Exemplary mouse PK curves for selected compounds following IV and subcutaneous administration can be found in FIG. 15A (IV) and FIG. 15B (subcutaneous), and in Table 8.

TABLE 8

Mouse Plasma pK Values for Fusion Proteins

| Molecule/Administration | IV half-life (hours) | Subcutaneous PK half-life (hours) |
|---|---|---|
| Asfotase alfa | 15.6 | 31.1 |
| ALP001 | 40 | N/D |
| ALP002 | 46 | 58 |
| ALP018 | 26 | N/D |
| ALP023 | 33 | N/D |
| ALP024 | 41 | N/D |
| ALP031 | 45 | N/D |
| ALP201 | 45 | 62 |
| ALP213 | 48 | 69 |
| ALP214 | 32 | N/D |
| ALP215 | 31 | N/D |
| ALP219 | 30 | N/D |
| ALP235 | 65 | 67 |
| ALP259 | 88 | 68 |

Example 7

Testing of Alkaline Phosphatase Constructs in a Mouse Efficacy Model of HPP

Preclinical efficacy studies of alkaline phosphatase constructs were performed using the Akp2GW (−/−) mouse model of HPP. The Akp2GW (−/−) mice share the same HPP-inducing TNSALP mutation used in the Akp2 (−/−) mice (Narisawa et al. 1997) that were previously used in the preclinical evaluation of asfotase alfa. In these studies, doses of test articles (ALP201 or vehicle (PBS)) were given subcutaneously into the scapular region, beginning on Day 1 after birth until Day 35. Outcomes reported included overall survival, body weight growth rate, bone mineralization of hind paw bones on Day 36 (or at death if before end-of-study [EOS]), and EOS trough plasma enzyme activity levels (taken on Day 36 in every day [QD] and every week [Q1W] groups, and on Day 37 in every 2 days [Q2D] dose groups). In some studies, EOS femur and tibia lengths and mouse femur alkaline phosphatase activity were determined.

Body weight was also evaluated on a daily basis as an indicator of the general well-being of animals. Age- and litter-matched PBS-treated WT mice served as reference controls. Animals in group 7 received same daily subcutaneous injection of ALP201 as groups 3 to 5 until day 24. On day 25, the daily subcutaneous dose of ALP201 was reduced by half-log of the initial dose and maintained until last treatment dose on day 35. ALP201 showed statistically significant improvement in survival and in bone mineralization, compared to negative (PBS) controls.

Figure 16:
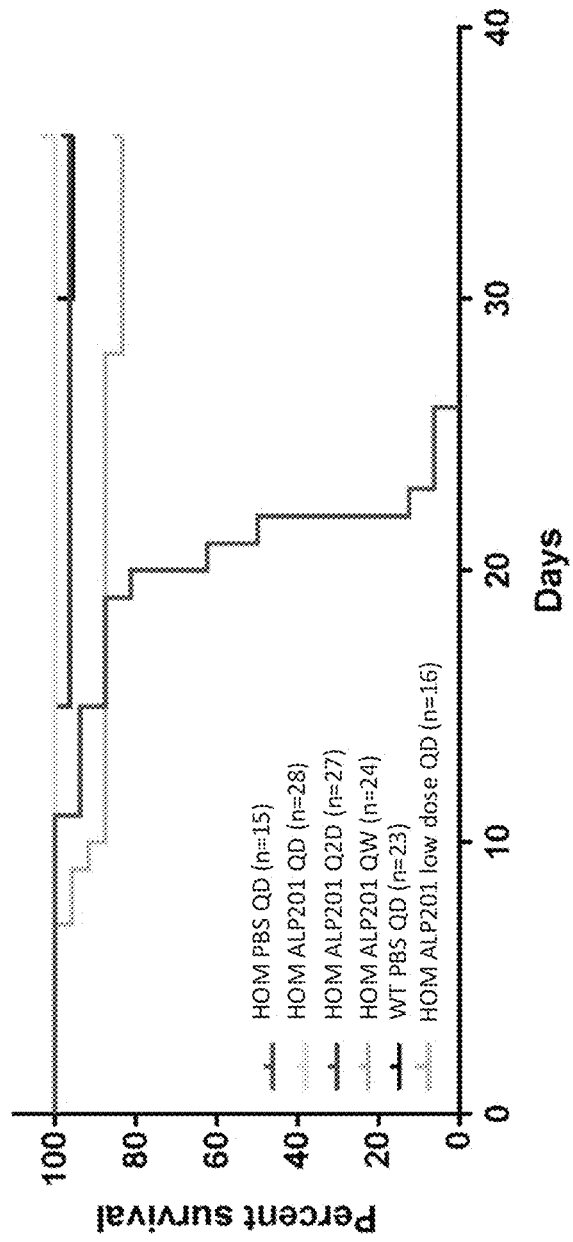
FIG. 16 is a graph showing Kaplan Meier survival curves of HPP mice treated subcutaneously with PBS daily or ALP201 on daily, every other day, and weekly dosing schedules. Median survival time for HOM PBS QD animals was 21.5 days.
Figure 17:
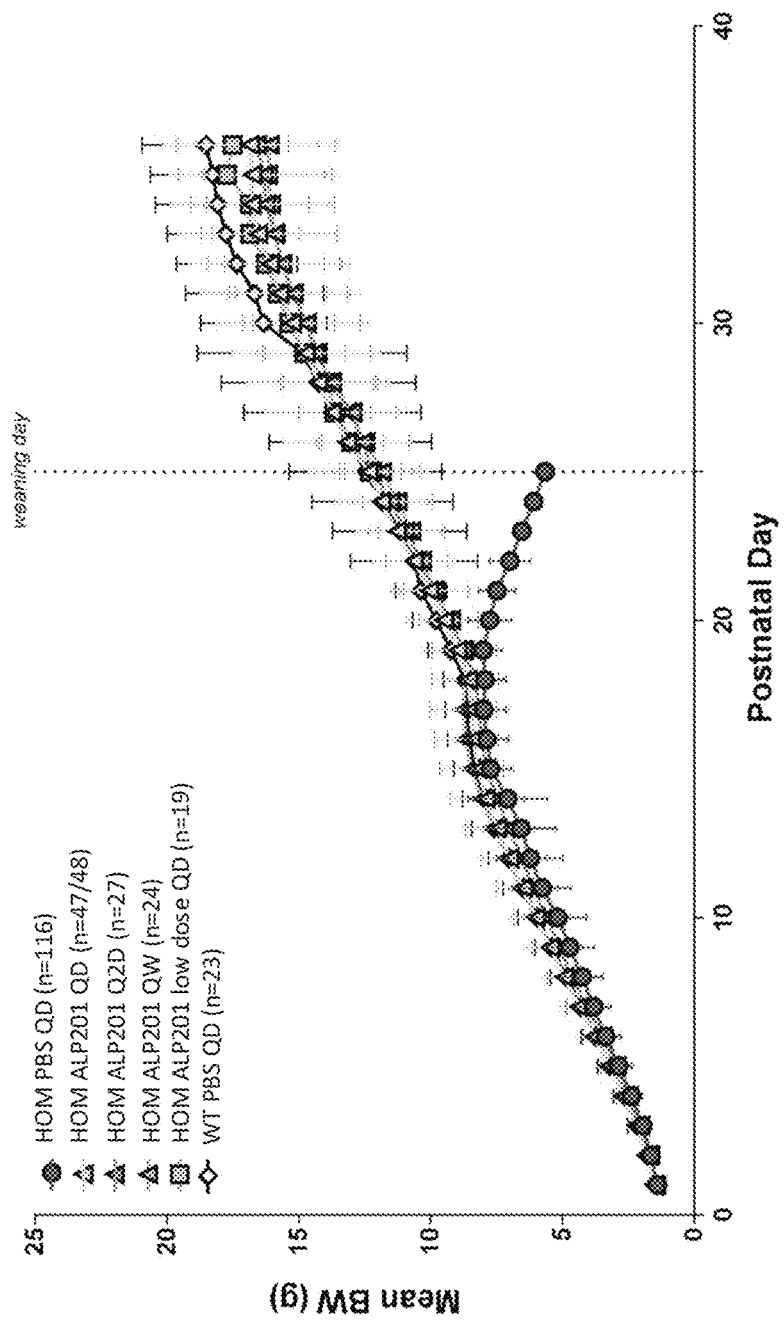
FIG. 17 is a graph showing mean body weight as a function of time (36 day study) of HPP mice treated with either ALP201 or PBS.
Figure 18:
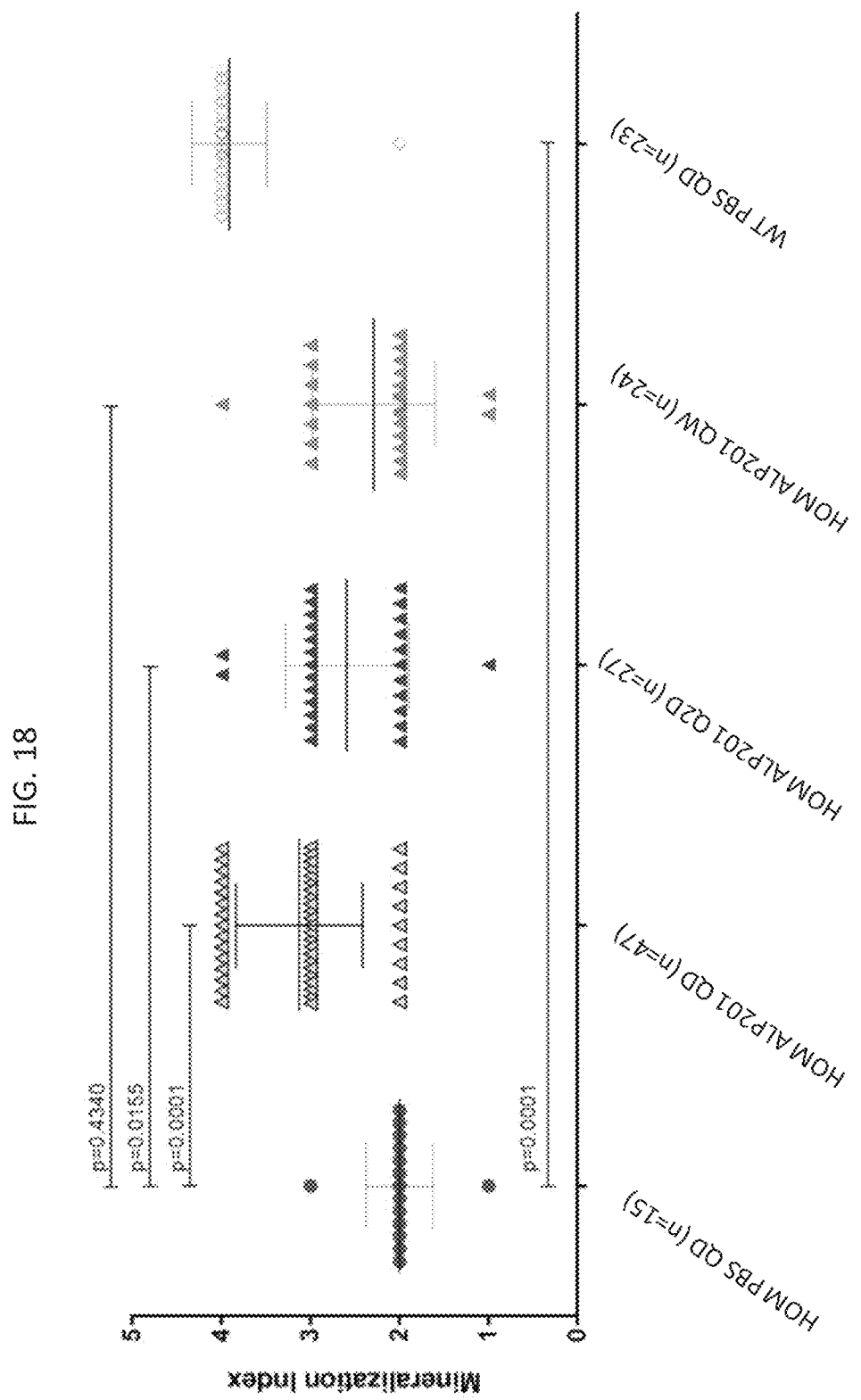
FIG. 18 is a graph showing hind paw mineralization index at day 11 of HPP mice treated with either ALP201 or PBS.

Survival curves are shown in FIG. 16 and mean body weight is graphed in FIG. 17. Correction of bone mineralization phenotype via hind paw mineralization index at day 11 is shown in FIG. 18. Tabulation of dose groups for these studies are listed in Table 9.

TABLE 9

Dose-Grouped Study Plans for Akp2GW (−/−) Efficacy Studies

| Study | Test Article | Dose (mg/kg) | Interval | Mouse Genotype |
|---|---|---|---|---|
| HPP-PoC-01 | ALP201 | 4.8 | QD | Akp2GW (−/−) |
| HPP-PoC-01 | ALP201 | 4.8 (days 1-25) 1.5 (days 26-35) | QD | Akp2GW (−/−) |
| HPP-PoC-01 | ALP201 | 4.8 | Q2D | Akp2GW (−/−) |
| HPP-PoC-01 | ALP201 | 4.8 | Q1W | Akp2GW (−/−) |
| HPP-PoC-01 | asfotase alfa | 9.8 | QD | Akp2GW (−/−) |
| HPP-PoC-01 | PBS | — | QD | Akp2GW (−/−) |
| HPP-PoC-01 | PBS | — | QD | Akp2GW (+/+) |
| HPP-MED-01 | ALP201 | 2 | Q2D | Akp2GW (−/−) |
| HPP-MED-01 | ALP201 | 0.8 | Q2D | Akp2GW (−/−) |
| HPP-MED-01 | ALP201 | 0.3 | Q2D | Akp2GW (−/−) |
| HPP-MED-01 | ALP201 | 0.15 | Q2D | Akp2GW (−/−) |
| HPP-MED-01 | asfotase alfa | 2.5 | QD | Akp2GW (−/−) |
| HPP-MED-01 | PBS | — | Q2D | Akp2GW (−/−) |
| HPP-MED-01 | PBS | — | Q2D | Akp2GW (+/+) |
| HPP-PoC-02 | ALP201 | 4.8 | Q2D | Akp2GW (−/−) |
| HPP-PoC-02 | ALP259 | 4.8 | Q2D | Akp2GW (−/−) |
| HPP-PoC-02 | PBS | — | Q2D | Akp2GW (−/−) |

Abbreviations: PBS = phosphate buffer saline; Q1W = once weekly; Q2D = every 2 days; QD = once daily; U MUP = Units of activity in 4-methylumbelliferyl phosphate hydrolysis.

Bone Mineralization Outcomes

Day 36/37 bone mineralization outcomes were determined by X-ray analysis of the hind paws of treated Akp2GW (−/−) mice. X-ray visualization of hind paw bone mineralization was compared to Day 36 benchmark X-ray images exemplifying 4 classification categories: Unaffected, Slight Deficit, Moderate Deficit, and Severe Deficit. Detailed descriptions of these classifications are found in Table 10. Blinded individuals assigned a score to images for each mouse, and once complete, scores were compiled within individual dose groups.

TABLE 10

Classification for Day 36 Hind Paw Bone Mineralization Index Scoring

| Score | Classification of Bone Mineralization Deficit | Description of Severity |
|---|---|---|
| 1 | Severe | Profound dysmorphology and complete absence of medial and distal phalanges of the digits and complete lack of secondary ossification centers |
| 2 | Moderate | Fully formed digits, but still no apparent secondary ossification centers |
| 3 | Slight | Fully formed digits with variable but incomplete secondary ossification centers |
| 4 | Unaffected | Fully formed digits and all secondary ossification centers present |

Figure 25:
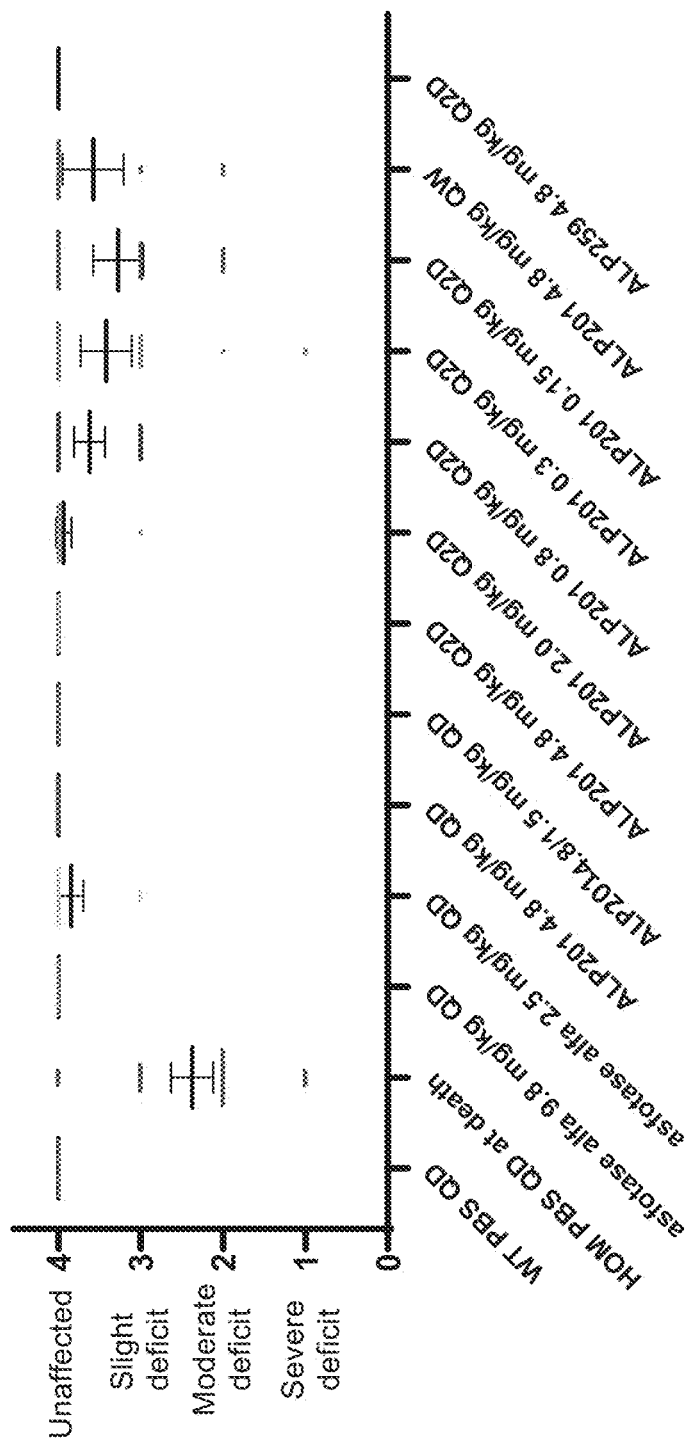
FIG. 25 is a graph showing hind paw mineralization index at day 36/37 of HPP mice treated with either ALP201, ALP259, asfotase alfa or PBS.

Distribution of bone mineralization index in efficacy studies is tabulated in Table 11, and shown graphically in FIG. 25.

TABLE 11

End of Study Bone Mineralization Index Distribution of Hind
Paw Bones in Treated Akp2GW (−/−) Mouse Groups

| Dose Group | # in Group | # Unaffected (Score = 4) | # Slight Deficit (Score = 3) | # Moderate Deficit (Score = 2) | # Severe Deficit (Score = 1) |
|---|---|---|---|---|---|
| WT PBS | 20 | 20 (100%) | 0 | 0 | 0 |
| ALP201 4.8 mg/kg QD | 25 | 25 (100%) | 0 | 0 | 0 |
| ALP201 4.8/1.5 mg/kg QD | 17 | 17 (100%) | 0 | 0 | 0 |
| ALP201 4.8 mg/kg Q2D | 24 | 24 (100%) | 0 | 0 | 0 |
| ALP201 2.0 mg/kg Q2D | 31 | 29 (93.5%) | 2 (6.5%) | 0 | 0 |
| ALP201 0.8 mg/kg Q2D | 29 | 18 (62.1%) | 11 (37.9%) | 0 | 0 |
| ALP201 0.3 mg/kg Q2D | 31 | 18 (58.1%) | 10 (32.3%) | 1 (3.2%) | 2 (6.5%) |
| ALP201 0.15 mg/kg Q2D | 29 | 14 (48.3%) | 9 (31.0%) | 6 (20.7%) | 0 |
| ALP201 4.8 mg/kg Q1W | 19 | 14 (73.7%) | 2 (10.5%) | 3 (15.8%) | 0 |
| asfotase alfa 9.8 mg/kg QD | 16 | 16 (100%) | 0 | 0 | 0 |
| asfotase alfa 2.5 mg/kg QD | 26 | 22 (84.6%) | 4 (15.4%) | 0 | 0 |
| HOM PBS (at death) | 50 | 7 (14.0%) | 12 (24.0%) | 24 (48.0%) | 7 (14.0%) |
| ALP259 4.8 mg/kg Q2D | 15 | 15 (100%) | 0 | 0 | 0 |

Abbreviations: HOM = homozygous knockout, PBS = phosphate buffered saline; QD = every day; Q2D = every 2 days, Q1W = once weekly; WT = wildtype.

Survival Outcomes

All PBS-treated Akp2GW (−/−) mice died on or before Day 26 of the studies, with a median survival time of 20 days. ALP201 and ALP259 treatment of Akp2GW (−/−) mice significantly improved 36-day survival rates in all dose groups relative to the PBS vehicle control (FIG. 16). All ALP201 dosing groups reached EOS survival rates of at least 69%, with all QD and Q2D interval dose groups above a dose of 0.15 mg/kg/day posting 88% or greater overall survival rates. Survival curves for ALP201 4.8 mg/kg Q1W group and asfotase alfa 9.8 mg/kg QD group have highly similar outcomes (Table 12 and FIG. 16).

TABLE 12

Survival Percentage Summary of Akp2GW (−/−) Mouse
Groups Treated in 36/37-Day Efficacy Studies

| Test Article | Dose (mg/kg) | Interval | End of Study Survival (%) |
|---|---|---|---|
| ALP201 | 4.8 | qd | 100 |
| ALP201 | 4.8/1.5 | qd | 100 |
| ALP201 | 4.8 | q2d | 96 |
| ALP201 | 2 | q2d | 94 |
| ALP201 | 0.8 | q2d | 97 |
| ALP201 | 0.3 | q2d | 88 |
| ALP201 | 0.15 | q2d | 69 |
| ALP201 | 4.8 | q1w | 83 |
| ALP259 | 4.8 | q2d | 100 |
| asfotase alfa | 9.8 | qd | 81 |
| asfotase alfa | 2.5 | qd | 96 |
| PBS | NA | NA | 0 |

End of Study Plasma Alkaline Phosphatase Activity Determination and Outcomes

Mouse plasma samples were collected and prepared at end of study—Day 36 in daily (QD) and weekly (Q1W) dosing groups, and Day 37 in every 2 day (Q2D) dose groups. Alkaline phosphatase activity in the plasma samples was assayed using the method outlined in Example 6. Measured rates of reaction in plasma samples were calculated using a standard curve to of known enzyme activity of obtain values for plasma alkaline phosphatase activity values in units of U/mL. Samples were run in duplicate twice to compile data for each independent sampling point. Values in U/mL were converted to units of mg/L by the relation:

Concentration in mg/L=(measured activity value of U/mL/specific activity of test article in U/mg)*1000.

Figure 28:
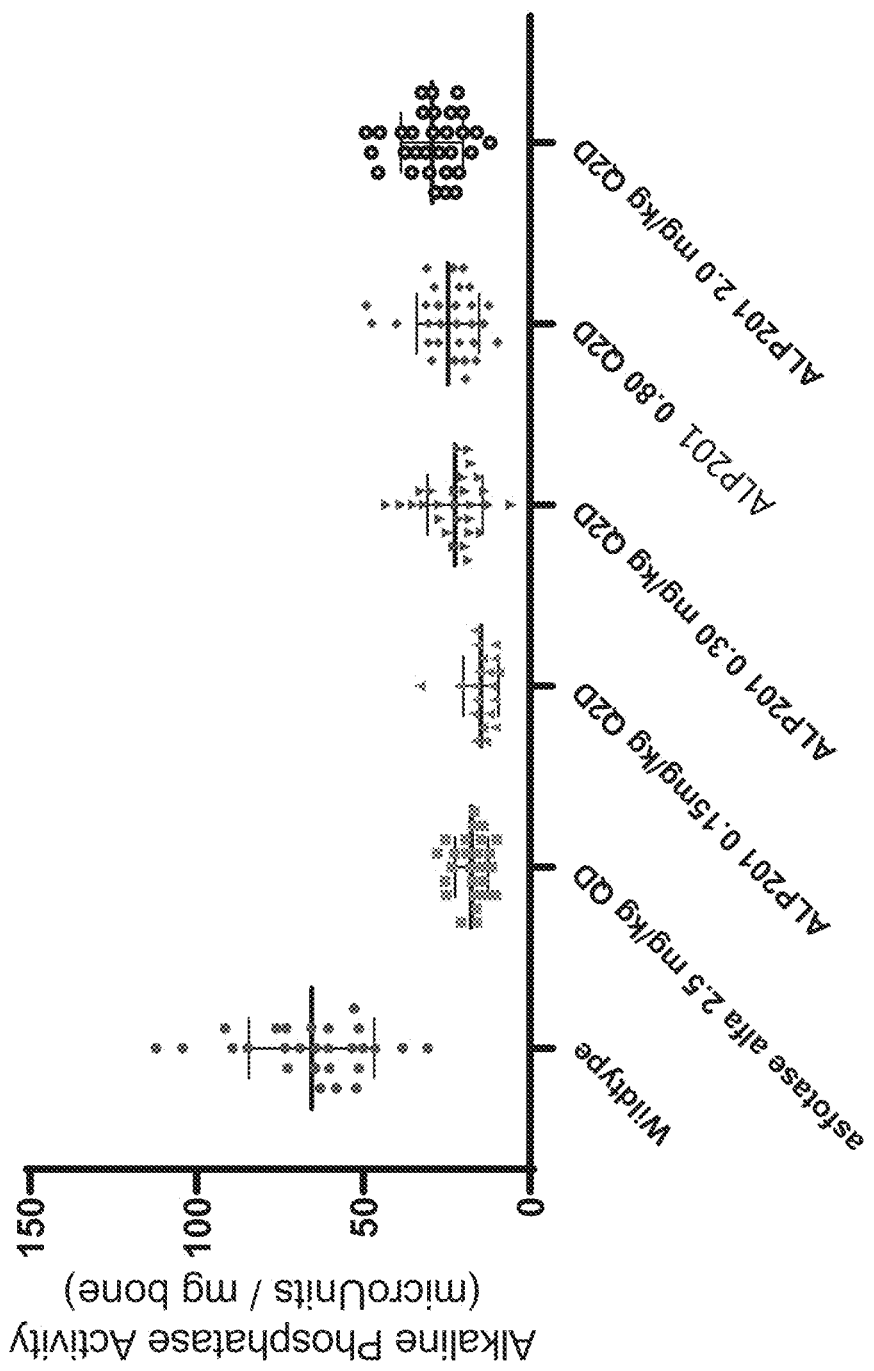
FIG. 28 is a graph showing mouse bone alkaline phosphatase activity levels at day 36/37 of HPP mice treated with either ALP201, asfotase alfa, or PBS

Distribution of end-of-study plasma activity levels are shown in FIG. 28, with mean values presented in Table 13.

TABLE 13

Dose Grouped Mean End-of-Study Trough
Plasma Active Enzyme Concentrations

| Construct | Dose (mg/kg) | Interval | Number doses in study | Mean End-of-Study Active Enzyme Concentration (ug/mL) | Day Collected |
|---|---|---|---|---|---|
| ALP201 | 4.8 | qd | 35 | 48.7 | 36 |
| ALP201 | 4.8/1.5 | qd | 35 | 21.8 | 36 |
| ALP201 | 4.8 | q2d | 18 | 19.7 | 37 |
| ALP201 | 2 | q2d | 18 | 6.4 | 37 |
| ALP201 | 0.8 | q2d | 18 | 3.6 | 37 |
| ALP201 | 0.3 | q2d | 18 | 1.5 | 37 |
| ALP201 | 0.15 | q2d | 18 | 0.6 | 37 |
| ALP201 | 4.8 | q1w | 5 | 0.6 | 36 |
| Asfotase alfa | 9.8 | qd | 35 | 6.2 | 36 |
| Asfotase alfa | 2.5 | qd | 35 | 1.0 | 36 |
| ALP259 | 4.8 | q2d | 18 | 51.8 | 37 |

End of Study Bone Tissue Alkaline Phosphatase Activity Determination

Mouse femur samples were harvested on day 36/37 of the study, cleaned of excess tissue, snap frozen, and stored at −80° C. Prior to analysis, the femur samples were transferred to dry ice, placed on a sterile, cold petri dish and cleaned to remove any residual connective tissue. With a bone scissor, the ends of the femurs were clipped off, and the shaft transferred into a 0.5 mL collection tube (prepared with a single hole punched in the bottom with a 20 gauge syringe needle) on wet ice. Collection tubes were loaded into 1.5 mL centrifuge tubes and spun at 4000 rpm for 30 seconds in a benchtop microcentrifuge, effectively draining the bone marrow from the mouse femurs. Prepared mouse femur shafts were weighed and transferred into 90 microliters of diluent buffer (50 mM HEPES pH 7.4, 150 mM NaCl, 1 mM MgCl$_2$, 1 mg/mL BSA) in a 96-well black opaque assay plate. If the mouse femur shaft was too long to fit in the assay well, the femur shaft was cut in half, and both halves placed in the same well.

On each assay plate, controls included femur shafts from untreated wildtype and AKP2GW (+/−) heterozygous mice that were held at 90° C. for 60 minutes prior to assay, effectively heat-killing the alkaline phosphatase activity on these bone samples, which served as negative controls for the assay.

A standard curve was generated on each plate using a dilution series of an alkaline phosphatase activity reference standard with known specific activity, transferred into the assay plate at final assay concentrations of 0, 1.25, 2.5, 5, 10, 20, 35, and 50 ng/mL.

Prior to assay, the plate was sealed and heated to 37° C. for 15 minutes on a Jitterbug heating plate shaker (with no shaking). Once warmed to 37° C., 160 mL of substrate solution (50 mM HEPES pH 7.4, 150 mM NaCl, 1 mM $MgCl_2$, 1 mg/mL BSA, 15.625-156.25 mM 4-MUP). Final concentration of 4-MUP in the wells was 10-100 uM in a 250 uL volume. Progress curves of 4-methylumbelliferone production were measured at 37° C. using either a Molecular Devices i3x plate reader (set with excitation λ=365 nm and emission λ=445 nm) or Molecular Devices Paradigm plate reader (set with excitation λ=360 nm filter and emission λ=445 nm filter).

Figure 29:
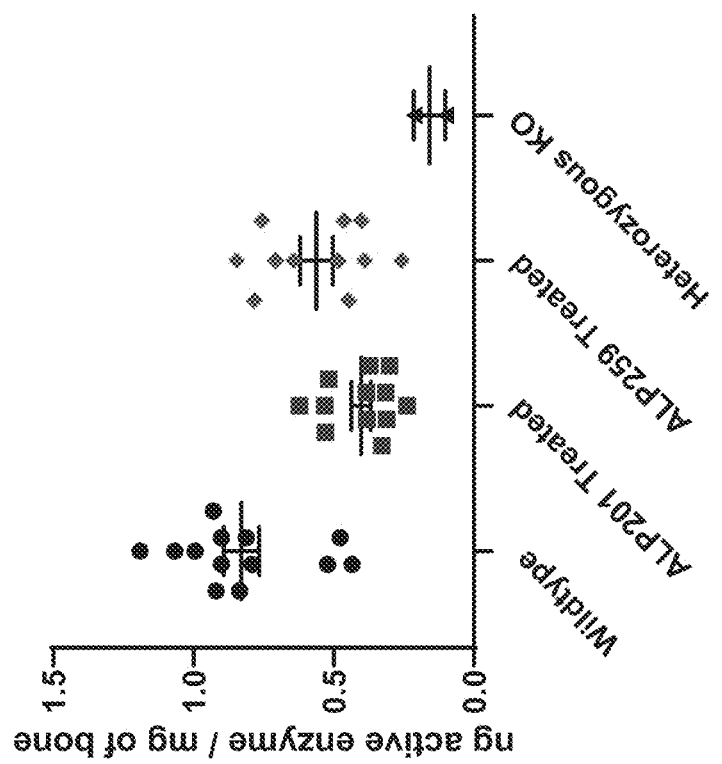
FIG. 29 is a graph showing mouse bone alkaline phosphatase activity levels at day 36/37 of Akp2GW HPP mice treated with either ALP201 or ALP259.
Figure 30:
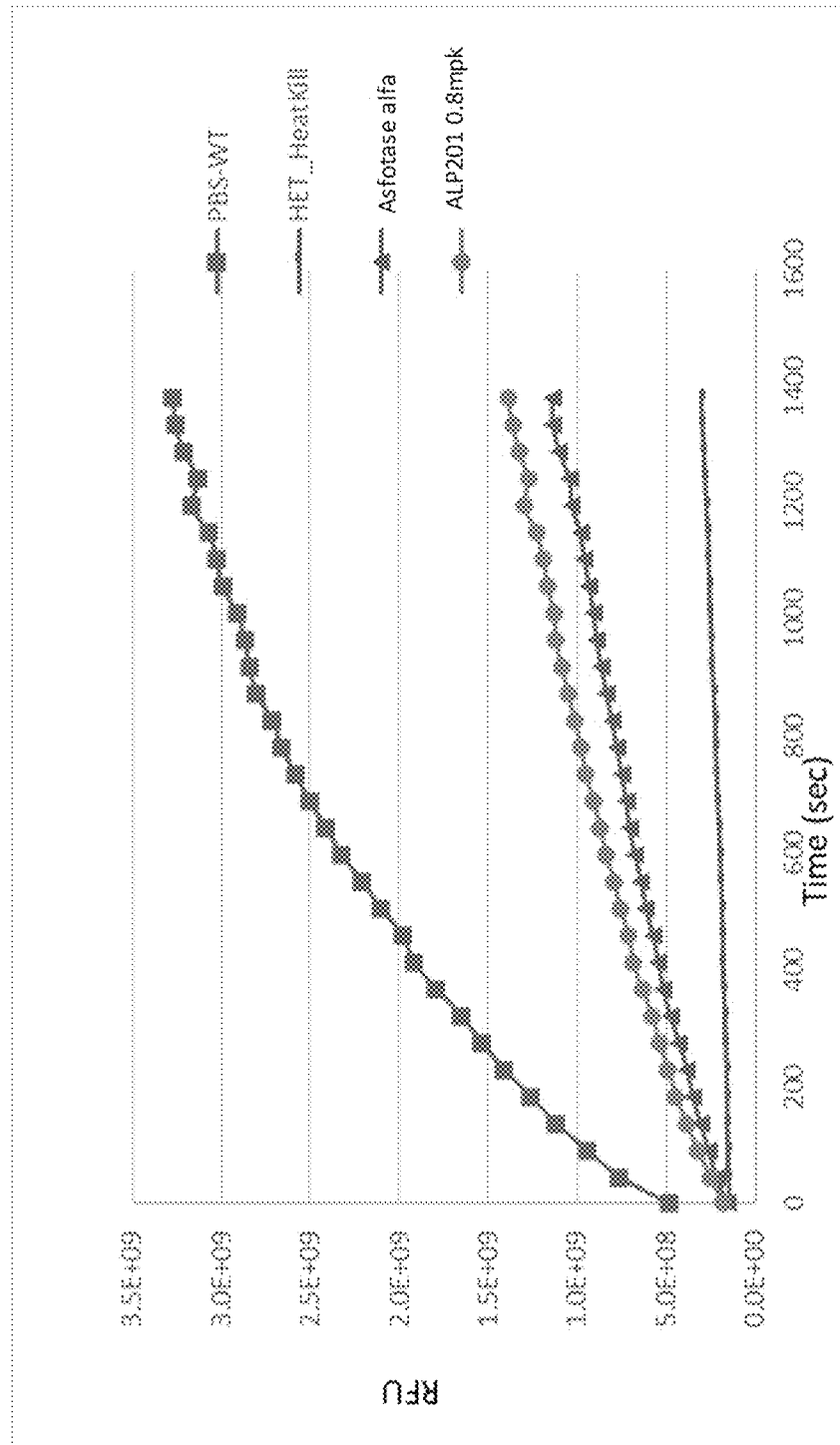
FIG. 30 is a graph showing an exemplary progress curve of a 4-MUP hydrolysis assay performed on HPP mouse femur tissue, with fluorescence (RFU) plotted versus time (sec).
Figure 31:
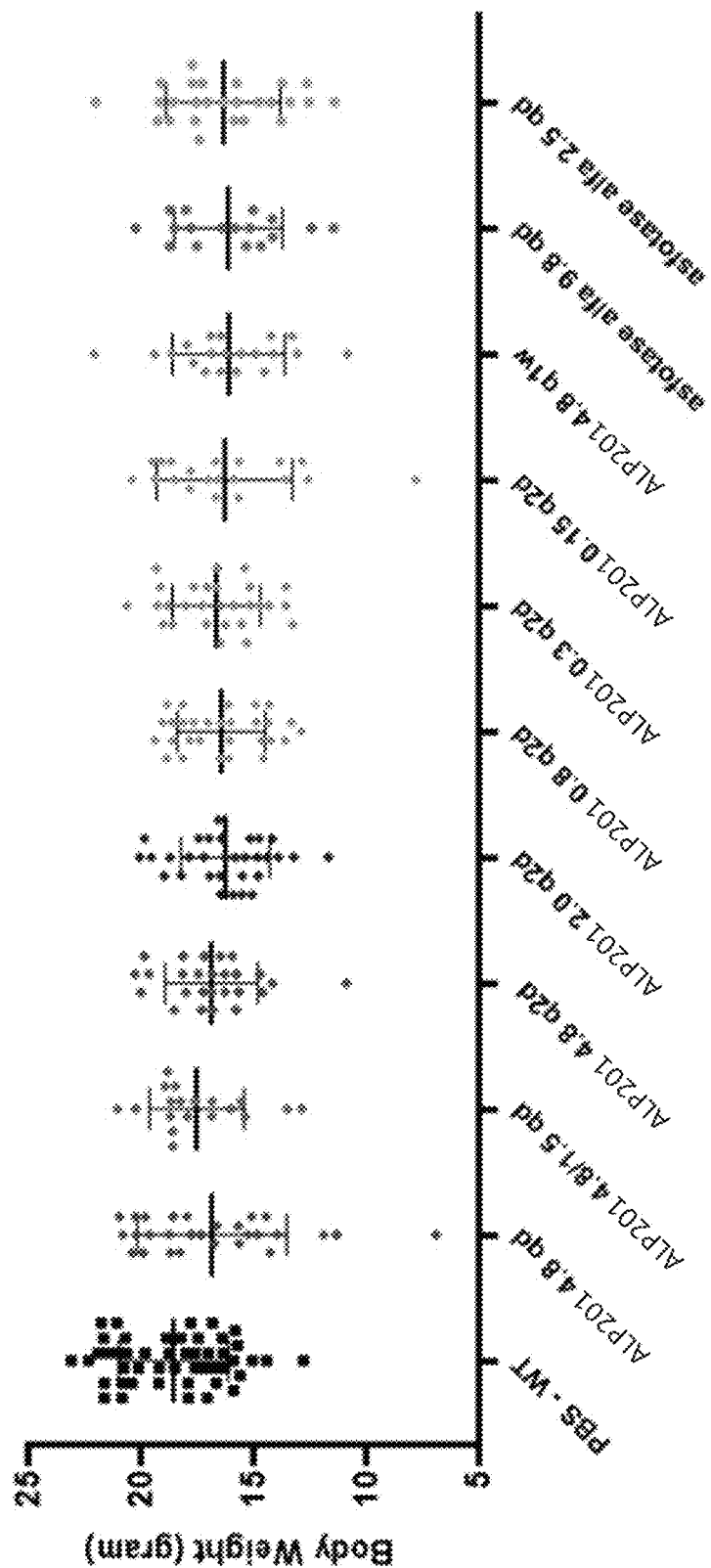
FIG. 31 is a graph showing day 36/37 body weight of HPP mice treated with either ALP201, asfotase alfa or PBS.

Activity slopes for all samples were calculated using linear regression in a commercial spreadsheet program (Microsoft Excel). In cases where the activity slope became visibly non-linear over the course of the experiment, linear regression to capture the initial rate of reaction was performed using the initial linear portion of the progress curve for the sample. Individual progress curve slopes were calculated in Relative Fluorescence Units (RFU)/minute. An example of progress curves for this assay is shown in FIG. 30, with the distribution of values from individual subjects plotted in FIG. 28 and FIG. 29.

Femurs of treated AkpGW (−/−) show clear increases in alkaline phosphatase activity (Table 14), demonstrating the capability of ALP201 and ALP259 to deliver enzyme activity to bone tissue.

TABLE 14

Measured End-of-Study Alkaline Phosphatase Activity on Treated Akp2GW (−/−) Mouse Femur Shafts

| Construct | Dose | Day Collected | Bone Alkaline Phosphatase Activity (% Units/mg of wildtype bone) |
|---|---|---|---|
| ALP201 | 2 mg/kg q2d | 37 | 44 |
| ALP201 | 0.8 mg/kg q2d | 37 | 34 |
| ALP201 | 0.3 mg/kg q2d | 37 | 31 |
| ALP201 | 0.15 mg/kg q2d | 37 | 21 |
| Asfotase alfa | 2.5 mg/kg q2d | 36 | 24 |
| ALP201 | 4.8 mg/kg q2d | 37 | 48 |
| ALP259 | 4.8 mg/kg q2d | 37 | 67 |

Tibia and Femur Length Outcomes

At end of study, tibia and femur lengths were measured using ImageJ software to take analysis points, one at each end of the bone image captured by Faxitron X-Ray so that the length of the longest part of the bone was captured by a straight line connecting the analysis points (ImageJ length). Bone length in millimeters (mm) was calculated using the formula:

$$mm = \frac{(ImageJ \text{ length from Faxitron } 2X \text{ maginification } JPEG)/2}{210*9.978}$$

Figure 26:
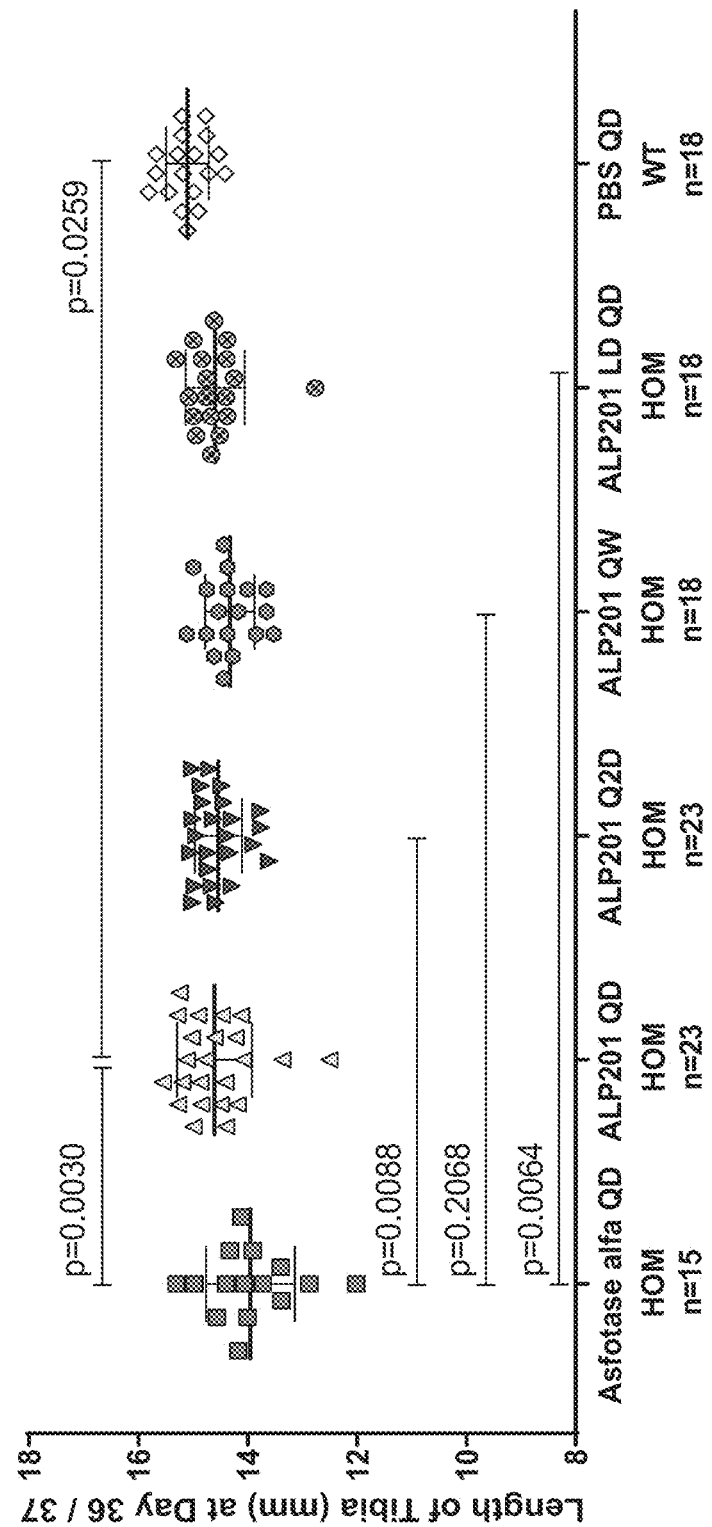
FIG. 26 is a graph showing tibia length at day 36/37 of HPP mice treated with either ALP201, asfotase alfa or PBS.
Figure 27:
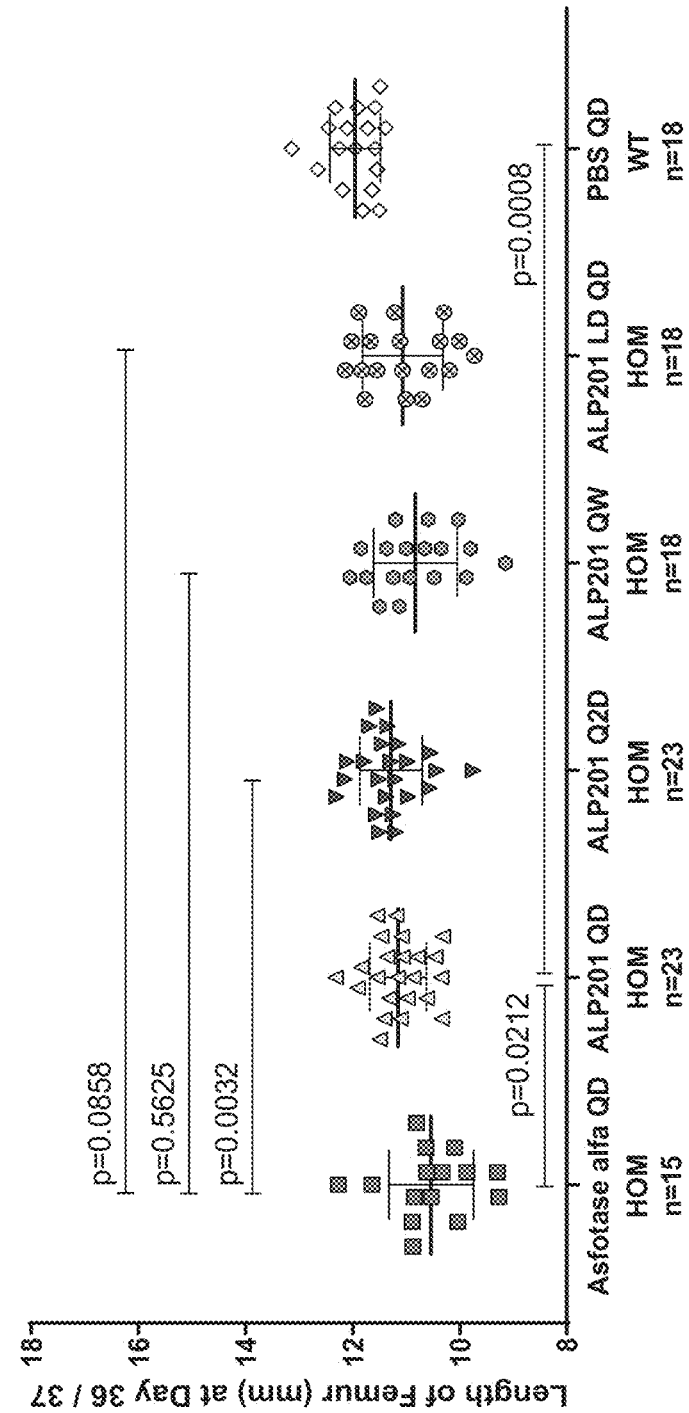
FIG. 27 is a graph showing femur length at day 36/37 of HPP mice treated with either ALP201, asfotase alfa or PBS.

Compared with asfotase alfa daily dosing at 9.8 mg/kg, AKP2GW (−/−) mice dosed daily and Q2D with ALP201 showed statistically significant improvement in both femur and tibia length, i.e., femur length p=0.0212 and p=0.0032, respectively, and tibia length p=0.0030 and p=0.0088, respectively, after 36/37 days of treatment, in a one-way ANOVA: Dunnett's multiple comparison test to asfotase alfa (FIG. 26, tibia, and FIG. 27, femur).

Body Weight Outcomes

Body weight was monitored for all mice in the efficacy studies. The body weight of ALP201 and ALP259 treated Akp2GW (−/−) mice in all treatment groups was consistently slightly lower than that of their wildtype littermates treated with PBS, but was never statistically significantly different for any group at any time point during the studies (FIG. 17).

ALP259 showed 2-fold greater enzymatic activity for pyrophosphate hydrolysis and 4-5-fold greater in vivo half-life after IV administration to C57BL/6 mice than asfotase alfa. ALP259 demonstrated roughly 50-fold greater end-of-study accumulation in plasma than asfotase alfa in the AKP2GW (−/−) mouse model of HPP, and 140% of the end-of-study AKP2GW(−/−) bone activity accumulation as ALP201. ALP259 demonstrated clear efficacy for bone mineralization in the AKP2GW(−/−) mouse model, with 100% of mice treated with 4.8 mg/kg on a q2d dose interval having normal bone mineralization, relative to <20% of untreated mice having a normal bone phenotype.

Example 8

In Vivo Characterization of Bone Targeting: In Vivo Fluorescent Imaging in Mice

Semi-quantitative biodistribution studies were performed in nude mice using ALEXA FLUOR® 750 labeled bone targeting proteins and protein fragments (VHH). Bone targeting ALP-Fc fusion proteins and bone targeting VHHs were fluorescently labeled with ALEXA FLUOR® 750 using Invitrogen SAIVI kit (covalent conjugation via activated succinimidyl esters), and purified in a gel exclusion resin to remove unconjugated fluorophore. Purified proteins (suspended in PBS) were injected into nude mice via tail vein at doses of ~3 mg/kg.

Female J:NU outbred mice (Jackson Laboratories, Bar Harbor, ME) received 3 mg/kg of test article via volume-normalized 100 μL intravenous tail vein injection. For in vivo image acquisition, subjects were maintained under 2-3% isoflurane anesthesia on the imaging platform (IVIS® Spectrum Imaging System, PerkinElmer Inc., Waltham, MA). Automatic exposure settings with field of view (FOV) C, F/Stop 2, medium binning and 800 nm emission/750 nm excitation filters were used for both 2D epi-illumination and 3D trans-illumination acquisitions. Ex vivo tissue specimen 2D epi-illumination fluorescent imaging was acquired under identical conditions less for the exception that all specimens for each tissue type were simultaneously acquired in a single image. All animal studies were conducted according to provisions of the Animal Welfare Act and the principles of the Guide for the Care and Use of Laboratory Animals.

Fluorescent imaging analysis was performed using manufacturer supplied 2D/3D software (Living Image 4.5.1, Perkin Elmer). Regions of interest (ROIs) of uniform area applied across each set of subjects were manually positioned to account for differences in subject positioning. Longitudinal in vivo image color scale ranges were normalized across all subjects and timepoints; ex vivo specimen color scales were individually determined to best represent the fluorescent signal for each tissue set. All images in FIGS. 4, 8, 12, and 13 are represented with the following parameters applied: Opacity=80, Color Table="Blue Hot," Smoothing=None, Logarithmic Scale. Read Bias Subtraction Adaptive FL Background Subtraction and Flat Field, Cosmic and Lens Distortion Corrects are also applied. ALEXA FLUOR® 750 signal is represented as radiant efficiency $(p/sec/cm^2/sr)/(\mu W/cm^2)$.

Ex vivo bone specimens were individually imaged on micro-computer tomography X-ray system (Quantum FX µCT, PerkinElmer, Inc., Waltham, MA). The following parameters were used for all acquisitions: Voltage=90 kV, Current=180 µA, FOV=40 mm and 17 second acquisition time. Quantitation of total bone volumes (Tt.BV, $mm^3$) was calculated using manufacturer supplied software (AccuCT 1.0 Advanced Analysis Software, PerkinElmer, Inc., Waltham, MA) using the Bone Growth workflow. Normalization of ALEXA FLUOR® 750 signal to bone volume is represented as $((p/sec/cm^2/sr)/(\mu W/cm^2))/mm^3$. Statistical analyses were performed using commercially available statistics software (GraphPad Prism 7, La Jolla, CA).

Figure 4:
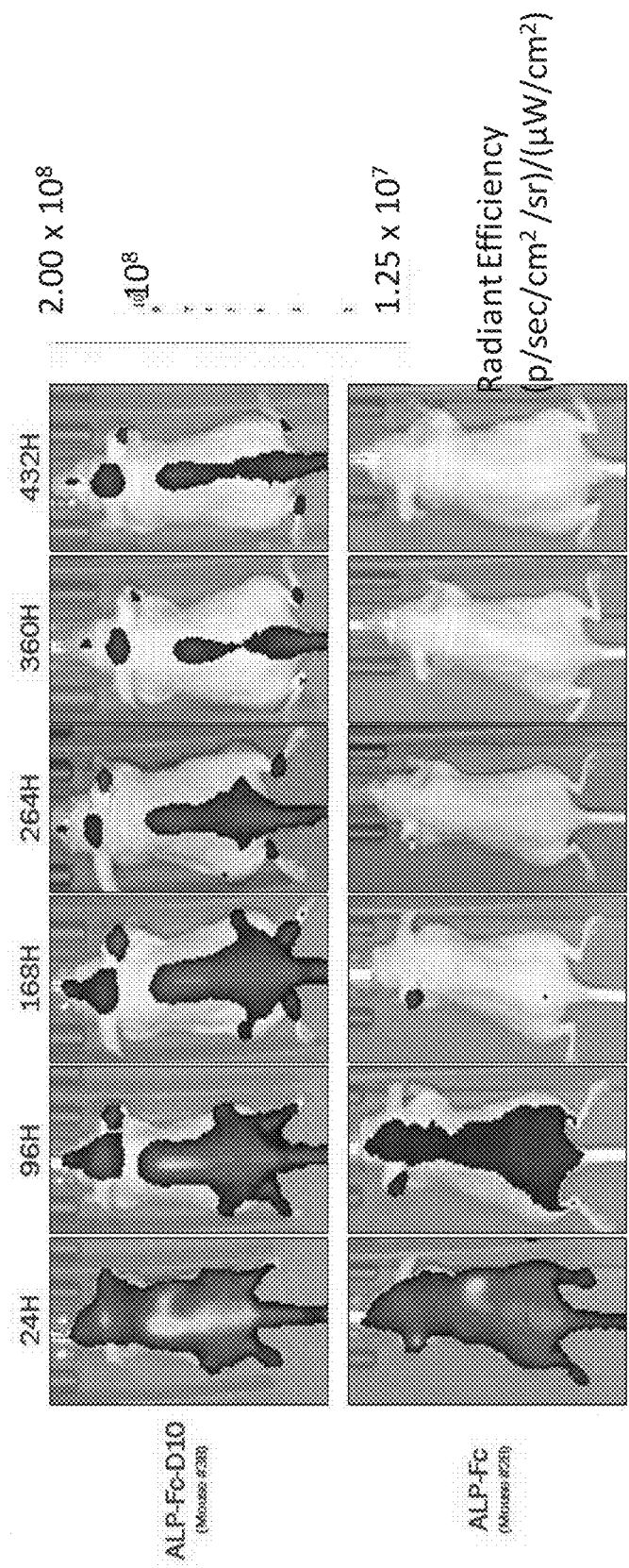
FIG. 4 is a set of representative raw fluorescent images of longitudinal whole body in vivo imaging spectrum (IVIS) live animal imaging of ALP-Fc-$D_{10}$ (ALP031; SEQ ID NO: 31) and ALP-Fc (ALP086; SEQ ID NO: 222) treated J:NU mice over time (24 to 432 hours).
Figure 5A:
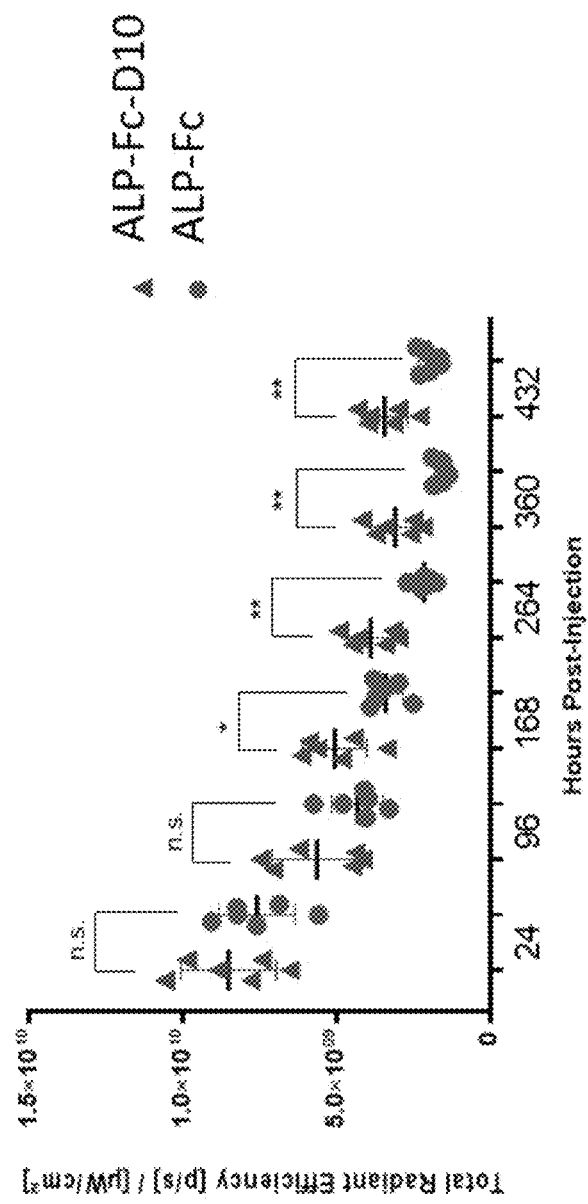
FIGS. 5A-5B are graphs showing quantitative data for longitudinal whole body IVIS live animal imaging of mice treated with ALP-Fc-$D_{10}$ (ALP031; SEQ ID NO: 31) or ALP-Fc (ALP086; SEQ ID NO: 222).
Figure 5B:
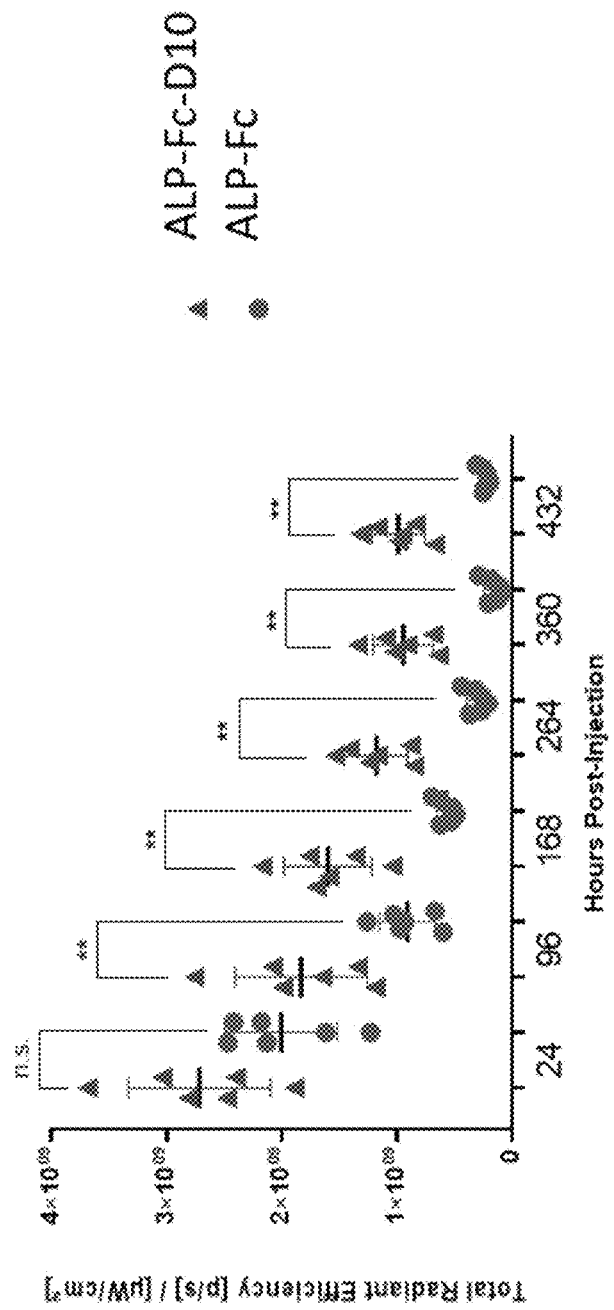

Because ALP-Fc-$D_{10}$ (SEQ ID NO: 31) maximized the possible signal of bone targeting proteins, and ALP-Fc (SEQ ID NO: 222) showed no binding to bone homogenate, these proteins were utilized as positive and negative control proteins for bone targeting experiments in vivo. Intravenous injections of ALEXA FLUOR® 750-labeled ALF-Fc or ALP-Fc-$D_{10}$ were administered to nude adolescent mice, and protein biodistribution was tracked in vivo throughout an 18-day study. Two-dimensional IVIS live animal fluorescent imaging was performed on all mice at days 1, 4, 7, 11, 15, and 18. At the end of the 18-day study, mice were sacrificed and ex vivo specific fluorescent imaging was performed on livers, kidneys, spleens, femurs, crania, and spines. FIGS. 4 and 5A-5B show the total radiant efficiency of fluorescent protein detected within whole body imaging gates. Quantitatively, average total radiant efficiency of mice treated with fluorescently-labeled bone targeted ALP-Fc-$D_{10}$ was similar to mice treated with untargeted ALP-Fc throughout the first 4 days after administration. However, at day 7 and beyond, ALP-Fc-$D_{10}$ showed significantly greater radiant efficiency than ALP-Fc due to the accumulation of targeted protein on bone and clearance of untargeted protein. FIG. 5B shows the comparison of the total radiant efficiency of the same treated mice within the spinal region of interest. In the spinal region of interest, statistical differences can be observed between targeted and untargeted ALP-Fc fusions within 4 days, and the difference remained throughout the 18-day study duration. FIG. 4 shows representative images from each treatment group at each imaging time point with the color scale indicating the radiant efficiency.

Figure 6A:
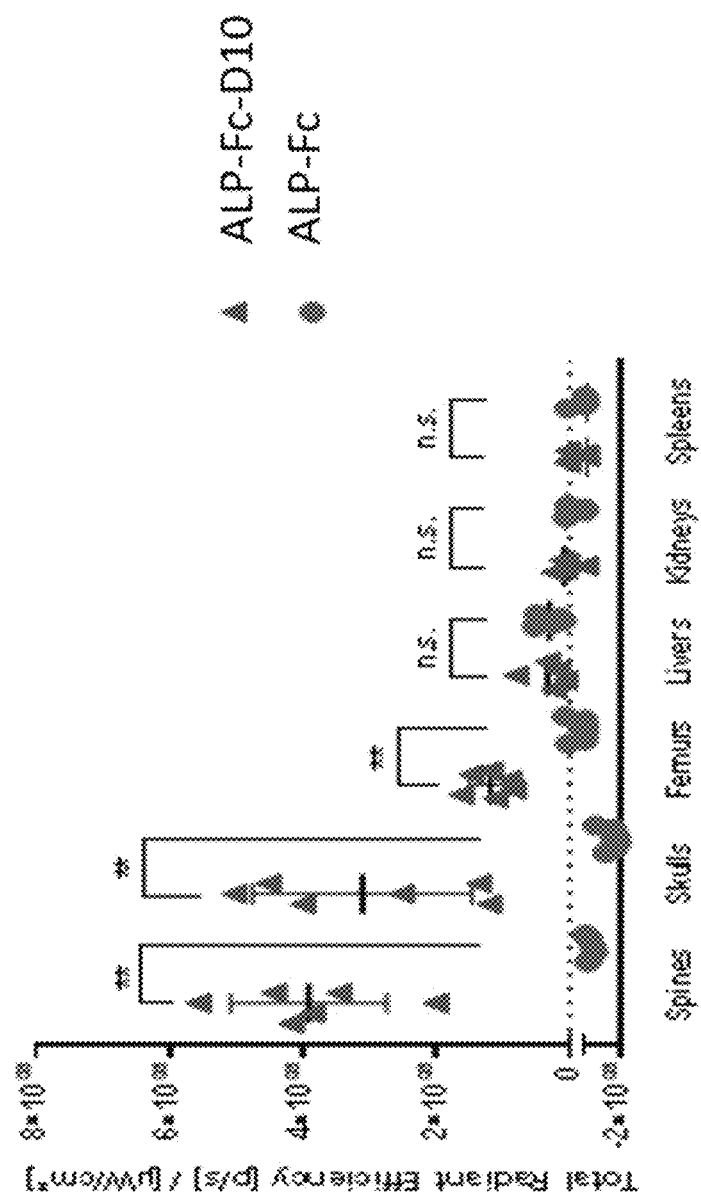
FIGS. 6A-6B are graphs showing ex vivo fluorescent quantitation of protein accumulation on select tissues (spine, skull, femur, liver, kidney, and spleen) after 18 days.
Figure 6B:
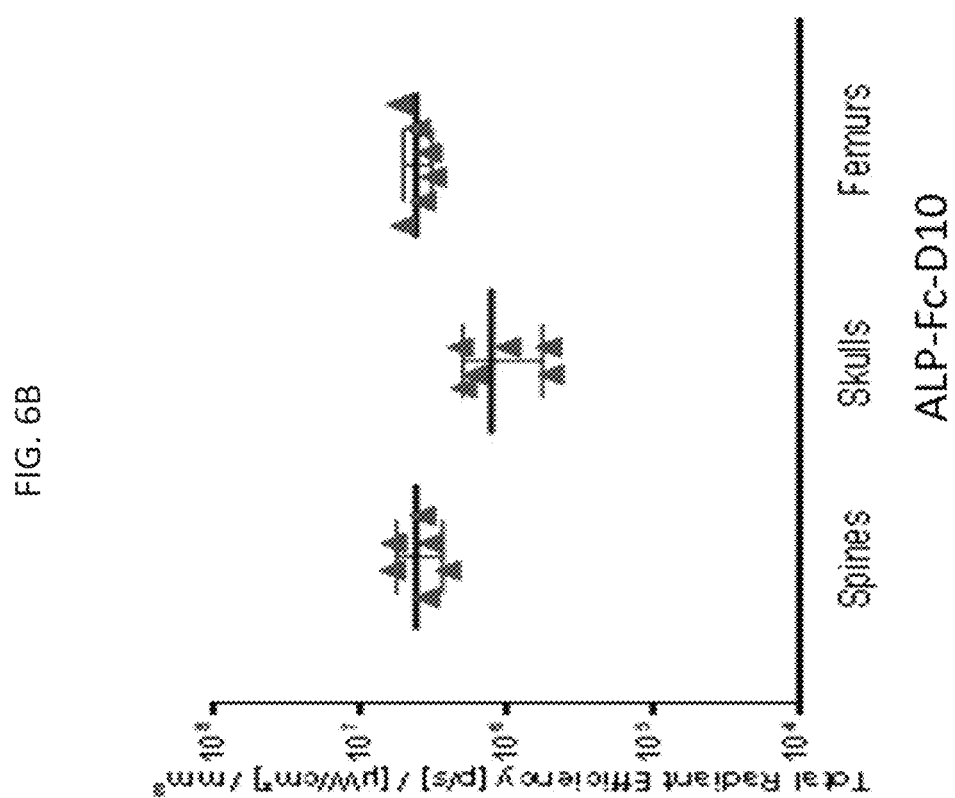
Figure 7:
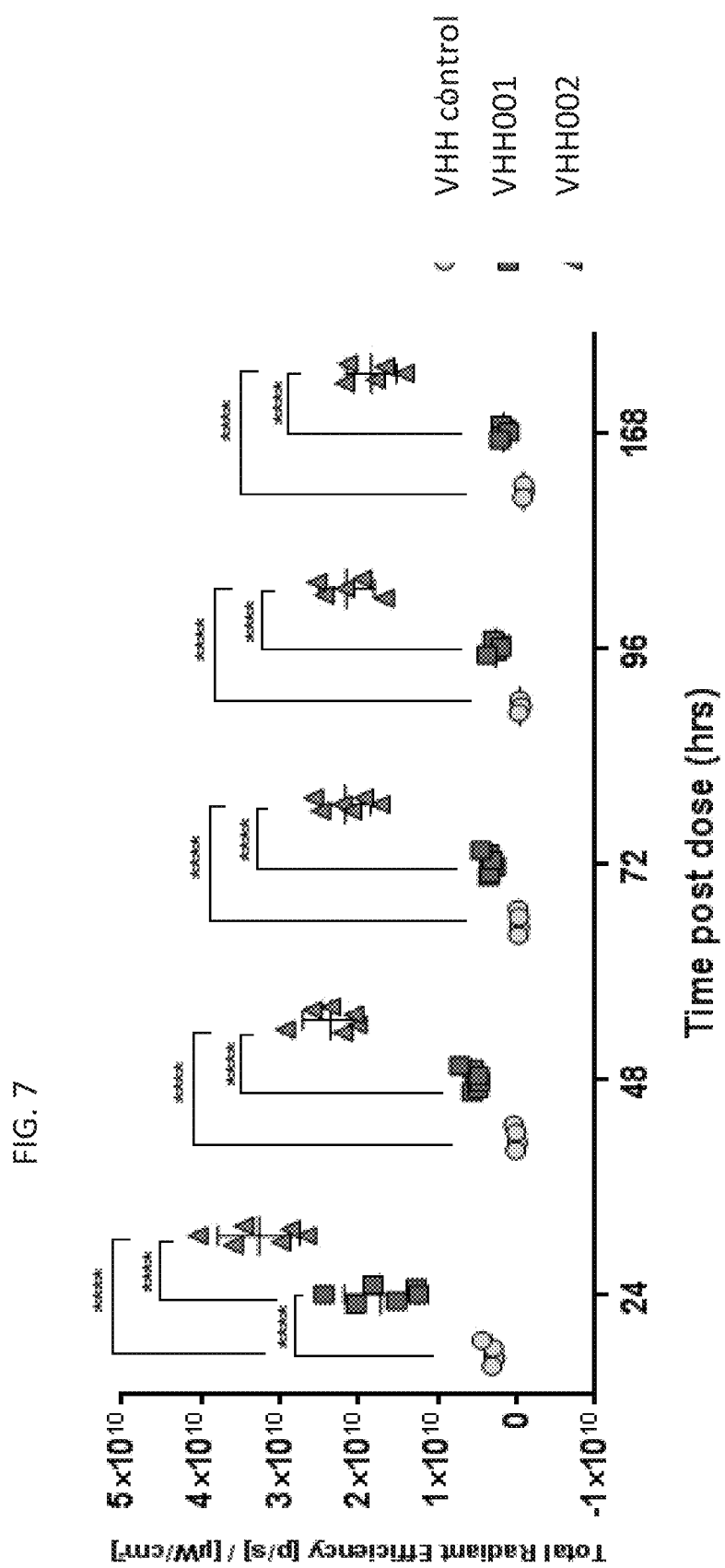
FIG. 7 is a graph showing representative 2D fluorescent IVIS images from a longitudinal study in mice administered a single IV dose of fluorescently labeled compounds with untargeted VHH (SEQ ID NO: 248), VHH001 (SEQ ID NO: 249), or VHH002 (SEQ ID NO: 250).

The newly developed bone homogenate screening assay was validated in vivo. By the developed screening assay, ALP-Fc-$D_{10}$ and ALP-Fc showed the two extremes of bone binding characteristics, quantitative binding of protein to bone homogenate, and no specific binding to bone homogenate, respectively. In vivo biodistribution studies showed extended retention of ALP031 within bone tissue beyond two weeks after single i.v. injections (FIG. 12, radiant efficiency shown in color scale). In contrast, ALP086 (untargeted ALP-Fc) was undetectable in vivo between 4 and 7 days post-injection (FIG. 13, radiant efficiency shown in color scale). In addition, intravenous administration of ALP031 resulted in equal distribution of drug throughout mineralized tissue in mouse spines, crania, and femurs (FIGS. 6A-6B). These results verified the bone homogenate screening assay distinguished bone targeting proteins from untargeted proteins.

Figure 8:
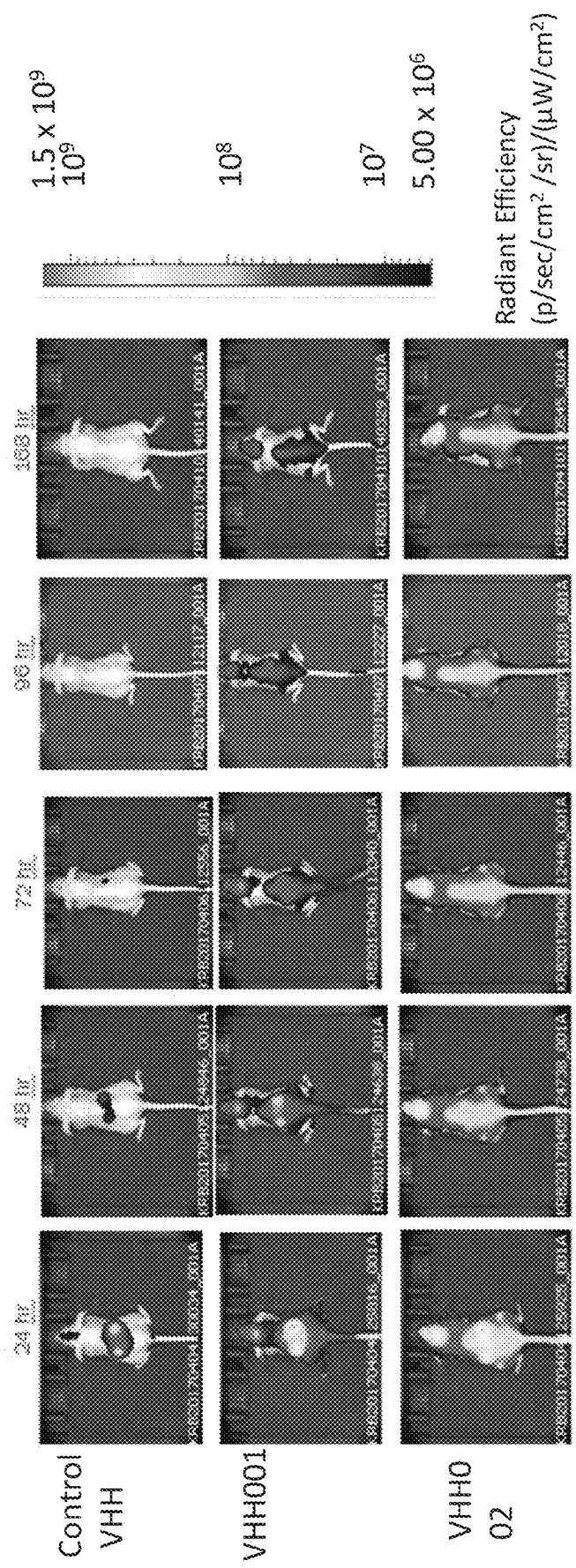
FIG. 8 is a set of raw fluorescent images showing quantitative data from the longitudinal study of total radiant efficiency of mice administered a single IV dose of fluorescently labeled compounds with untargeted VHH (SEQ ID NO: 248), VHH001 (SEQ ID NO: 249), or VHH002 (SEQ ID NO: 250), from 2D IVIS images. Radiant efficiencies were obtained from whole mouse regions of interest (ROIs). N=5±SD, **** p<0.0001, one-way ANOVA, Tukey's post-hoc analysis.
Figure 9A:
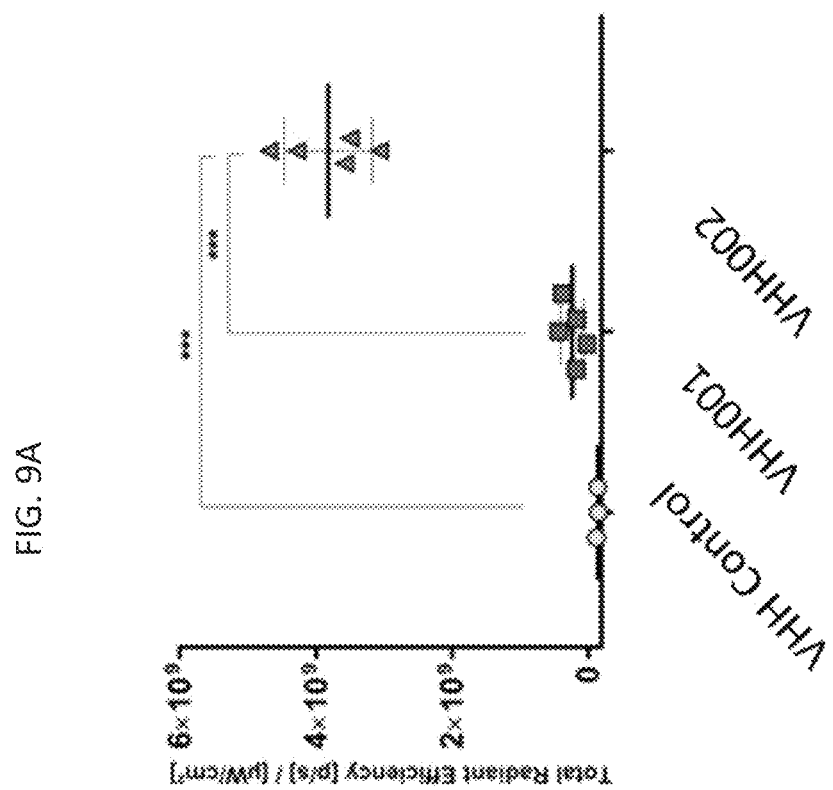
FIGS. 9A-9C are graphs showing quantitation of ex vivo bone tissues from mice dosed with fluorescently labeled compounds with untargeted VHH (SEQ ID NO: 248), VHH001 (SEQ ID NO: 249), and VHH002 (SEQ ID NO: 250).
Figure 9B:
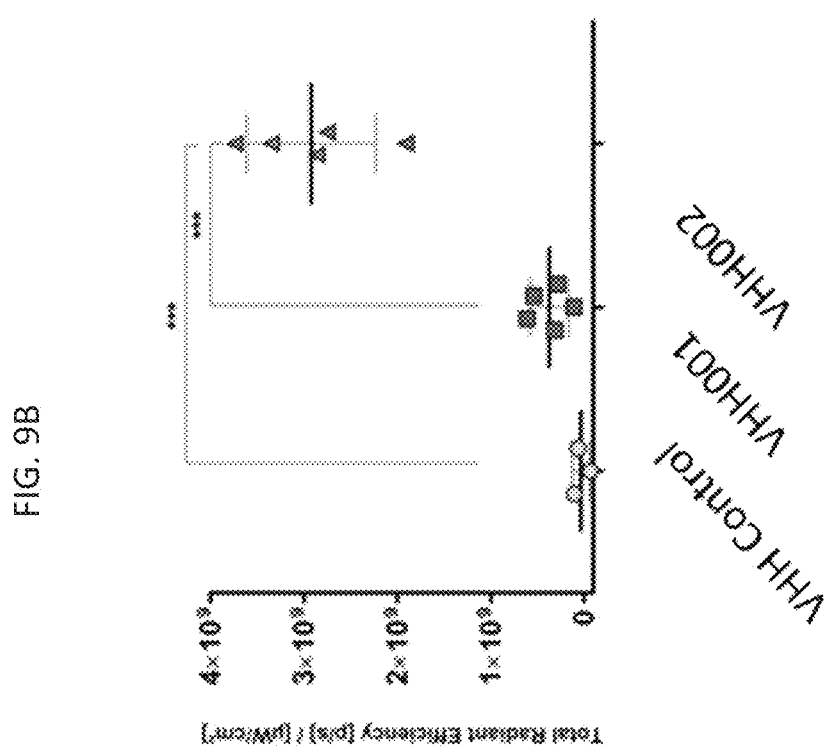
Figure 9C:
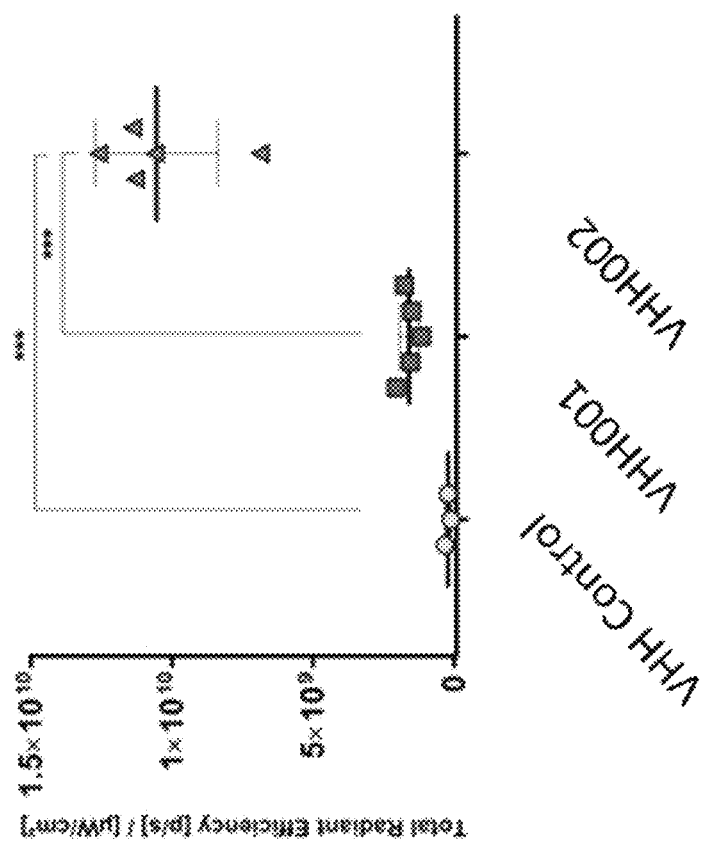

Further in vivo study of the VHH constructs differentiated between highly efficient bone binders and intermediate bone binding proteins with lower affinity (FIGS. 7, 8, 9A-9C, and 10A-10B). For this purpose, it was advantageous to study VHH proteins in vivo because untargeted VHH proteins were rapidly cleared from systemic circulation via renal excretion, which limited background signal and allowed earlier differentiation of bone localization. FIG. 8 showed increased whole body fluorescent signal of VHH001- and VHH002-treated mice 24 hours post-injection compared to the untargeted control, and enhanced signal of VHH002 compared to VHH001. Over time, signal from VHH001-treated mice approached baseline levels of the untargeted control, where signal from VHH002-treated mice remained significantly increased throughout the 7 day study. This bone targeting behavior was observed in the developed in vitro screening assay, which differentiated untargeted VHH control proteins from intermediate binding of VHH001 and highly efficient binding of VHH002, indicating a verifiable correlation between screening and in vivo bone targeting.

Example 9

An adult male subject presents with an elevated inorganic pyrophosphate (PPi) concentration of about 5.82 µM, an average BOT-2 strength score of less than 10. The subject is 24 years old and is experiencing painful lower limbs and gait disturbance. The subject may be diagnosed with HPP and selected for treatment. The subject can be subjected to an X-ray and a bone mineral density test, both of which may show reduced bone mineralization in the legs.

A pharmaceutical formulation containing the polypeptide of SEQ ID NO: 72 can be formulated at 0.1 mg/mL. The formulation can be injected subcutaneously into the subject once a week for 8 weeks at a dosage of 0.1 mg/kg/week. The subject can be evaluated for treatment efficacy after the 8 week treatment regimen. The subject may notice a reduction in bone pain and normalization of gait. The subject can be subjected to follow-up X-rays and bone mineral density tests, which may show normalization of bone mineralization relative to before treatment. The PPi concentration of the subject can be reduced to under 5 µM, and his BOT-2 strength score can improve to 12, indicative of a treatment effect by the polypeptide.

Example 10

An adolescent female subject presents with an elevated inorganic pyrophosphate (PPi) concentration of about 4.78 µM and an average 6MWT of less than about 70% of the predicted 6MWT value. The subject is 14 years old and is experiencing tooth loss and chronic pain. The subject may be diagnosed with HPP and selected for treatment. The subject can be subjected to an X-ray and a bone mineral density test, both of which may show may bone mineralization in her teeth and femurs.

A pharmaceutical formulation containing the polypeptide of SEQ ID NO: 123 can be formulated at 0.5 mg/mL. The formulation can be injected subcutaneously into the subject once a week for 4 weeks at a dosage of 0.5 mg/kg/week. The subject can be evaluated for treatment efficacy after the 4 week treatment regimen. The subject may notice a reduction in chronic pain. The subject can be subjected to follow-up X-rays and bone mineral density tests, which may show normalization of bone mineralization in her femurs relative to before treatment. The PPi concentration of the subject can be reduced to under 4 µM, and her 6MWT score improves to about 85% of the predicted value, indicative of a treatment effect by the polypeptide.

Example 11

An adolescent female subject presents with an elevated inorganic pyrophosphate (PPi) concentration of about 4.85 µM and an average 6MWT of less than about 65% of the predicted 6MWT value. The subject is 15 years old and is experiencing tooth loss and chronic pain. The subject may be diagnosed with HPP and selected for treatment. The subject can be subjected to an X-ray and a bone mineral density test, both of which may show may bone mineralization in her teeth and femurs.

A pharmaceutical formulation containing the polypeptide of SEQ ID NO: 177 can be formulated at 0.7 mg/mL. The formulation can be injected subcutaneously into the subject once a week for 6 weeks at a dosage of 0.7 mg/kg/week. The subject can be evaluated for treatment efficacy after the 6 week treatment regimen. The subject may notice a reduction in chronic pain. The subject can be subjected to follow-up X-rays and bone mineral density tests, which may show normalization of bone mineralization in her femurs relative to before treatment. The PPi concentration of the subject can be reduced to under 4 µM, and her 6MWT score improves to about 88% of the predicted value, indicative of a treatment effect by the polypeptide.

OTHER EMBODIMENTS

The foregoing detailed description and examples have been given for clarity of understanding only. No unnecessary limitations are to be understood therefrom. The invention is not limited to the exact details shown and described, for variations apparent to one skilled in the art will be included within the invention defined by the claims.

Unless otherwise indicated, all numbers expressing quantities of components, molecular weights, and so forth used in the specification and claims are to be understood as being modified in all instances by the term "about." Accordingly, unless otherwise indicated to the contrary, the numerical parameters set forth in the specification and claims are approximations that may vary depending upon the desired properties sought to be obtained by the invention. At the very least, and not as an attempt to limit the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. All numerical values, however, inherently contain a range necessarily resulting from the standard deviation found in their respective testing measurements.

The complete disclosures of all patents, patent applications including provisional patent applications, publications including patent publications and nonpatent publications, and electronically available material (including, for example, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference. The foregoing detailed description and examples have been given for clarity of understanding only. No unnecessary limitations are to be understood therefrom. The disclosure is not limited to the exact details shown and described, for variations apparent to one skilled in the art will be included within the embodiments defined by the claims.

SEQUENCE LISTING (269 sequences)

SEQ ID NO: 1 - protein, 507 aa, Homo sapiens
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 2 - protein, 513 aa, Homo sapiens
IIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 3 - protein, 513 aa, Homo sapiens
IIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 4 - protein, 508 aa, Homo sapiens
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAA

SEQ ID NO: 5 - protein, 507 aa, Macada Mulatta
LVPEKEKDPKYWRDQAQETLKYALELQKLNTNVAKNVIMFLGDGMGVSTVTATRILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLVHNIRDIDVIMGGGRKYMYPKNKTDVEYEIDEKARGTRLDGLDLVNIWKSFKPRHKHSHFIWNRTELLTLDPHNVDYLLGLFEPGDMEYELNRNNVTDPSLSEMVVVAIQILRKNPKGFFLLVEGGRIDHGHHEGKAKQALHEAVEMDRAIGQAGSMTSLEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYIPHVMAYAACIGANLDHCAPASSAGSLAAGPLLLPLALFPLSILF

SEQ ID NO: 6 - protein, 507 aa, Mus Musculus
FVPEKERDPSYWRQQAQETLKNALKLQKLNTNVAKNVIMFLGDGMGVSTVTAARILKGQLHHNTGEETRLEMDKFPFVALSKTYNTNAQVPDSAGTATAYLCGVKANEGTVGVSAATERTRCNTTQGNEVTSILRWAKDAGKSVGIVTTTRVNHATPSAAYAHSADRDWYSDNEMPPEALSQGCKDIAYQLMHNIKDIDVIMGGGRKYMYPKNRTDVEYELDEKARGTRLDGLDLISIWKSFKPRHKHSHYVWNRTELLALDPSRVDYLLGLFEPGDMQYELNRNNLTDPSLSEMVEVALRILTKNLKGFFLLVEGGRIDHGHHEGKAKQALHEAVEMDQAIGKAGAMTSQKDTLTVVTADHSHVFTFGGYTPRGNSIFGLAPMVSDTDKKPFTAILYGNGPGYKVVDGERENVSMVDYAHNNYQAQSAVPLRHETHGGEDVAVFAKGPMAHLLHGVHEQNYIPHVMAYASCIGANLDHCAWAGSGSAPSPGALLLPLAVLSLRTLF

SEQ ID NO: 7 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 8 - protein, 719 aa, Artificial Sequence
  Synthetic Construct
IIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 9 - protein, 719 aa, Artificial Sequence
  Synthetic Construct
IIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHLFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 10 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 11 - protein, 724 aa, Artificial Sequence
  Synthetic Construct
LVPEKEKDPKYWRDQAQETLKYALELQKLNTNVAKNVIMFLGDGMGVSTVTATRILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLVHNIRDIDVIMGGGRKYMYPKNKTDVEYEIDEKARGTRLDGLDLVNIWKSFKPRHKHSHFIWNRTELLTLDPHNVDYLLGLFEPGDMEYELNRNNVTDPSLSEMVVVAIQILRKNPKGFFLLVEGGRIDHGHHEGKAKQALHEAVEMDRAIGQAGSMTSLEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYIPHVMAYAACIGANLDHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 12 - protein, 724 aa, Artificial Sequence
  Synthetic Construct
FVPEKERDPSYWRQQAQETLKNALKLQKLNTNVAKNVIMFLGDGMGVSTVTAARILKGQLHHNTGEETRLEMDKFPFVALSKTYNTNAQVPDSAGTATAYLCGVKANEGTVGVSAATERTRCNTTQGNEVTSILRWAKDAGKSVGIVTTTRVNHATPSAAYAHSADRDWYSDNEMPPEALSQGCKDIAYQLMHNIKDIDVIMGGGRKYMYPKNRTDVEYELDEKARGTRLDGLDLISIWKSFKPRHKHSHYVWNRTELLALDPSRVDYLLGLFEPGDMQYELNRNNLTDPSLSEMVEVALRILTKNLKGFFLLVEGGRIDHGHHEGKAKQALHEAVEMDQAIGKAGAMTSQKDTLTVVTADHSHVFTFGGYTPRGNSIFGLAPMVSDTDKKPFTAILYGNGPGYKVVDGERENVSMVDYAHNNYQAQSAVPLRHETHGGEDVAVFAKGPMAHLLHGVHEQNYIPHVMAYASCIGANLDHCAWAGSGSAPSAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 13 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 14 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 15 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGEREQVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 16 - protein, 721 aa, Artificial Sequence
  Synthetic Construct
IIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAASSVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 17 - protein, 721 aa, Artificial Sequence
  Synthetic Construct
IIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 18 - protein, 721 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAASSVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 19 - protein, 721 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 20 - protein, 724 aa, Artificial Sequence
  Synthetic Construct
IIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

SEQ ID NO: 21 - protein, 724 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

SEQ ID NO: 22 - protein, 725 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAASVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 23 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAASSVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 24 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 25 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPACTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 26 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 27 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 28 - protein, 725 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAASVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 29 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAASSVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 30 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 31 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 32 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCQTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 33 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWQRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 34 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 35 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANAGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 36 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 37 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANAGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 38 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLREETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 39 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 40 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLRHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 41 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 42 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 43 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 44 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 45 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 46 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 47 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 48 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 49 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 50 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLREETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 51 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLREETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 52 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLREETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 53 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLREETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 54 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 55 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 56 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 57 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 58 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 59 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 60 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 61 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 62 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 63 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANRGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 64 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANNGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 65 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANDGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 66 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANQGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 67 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANGGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 68 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANHGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 69 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANIGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 70 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANLGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 71 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANKGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 72 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 73 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANFGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 74 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANPGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 75 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANSGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 76 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANTGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 77 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANWGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 78 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANYGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 79 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANVGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 80 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPALSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 81 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPRLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 82 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPNLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 83 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPDLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 84 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPQLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 85 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPELSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 86 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPGLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 87 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPHLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 88 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPILSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 89 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPLLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 90 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPKLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 91 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPFLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 92 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPSLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 93 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPTLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 94 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPYLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 95 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPVLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 96 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMVSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 97 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMKSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 98 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMASDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 99 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMNSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 100 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMHSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 101 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMQSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 102 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMSSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 103 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMTSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 104 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLAHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 105 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLNHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 106 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 107 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 108 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLGHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 109 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLHHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 110 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLIHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 111 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLLHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 112 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLKHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 113 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLMHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 114 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLFHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 115 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLTHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 116 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLYHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 117 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLVHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 118 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 119 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLEEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 120 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLTEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 121 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLVEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 122 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANQGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 123 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 124 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANLGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 125 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANKGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 126 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANSGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 127 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANTGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 128 - protein, 719 aa, Artificial Sequence; identical to SEQ ID NO: 56
  Synthetic Construct

SEQ ID NO: 129 - protein, 719 aa, Artificial Sequence; identical to SEQ ID NO: 55
  Synthetic Construct

SEQ ID NO: 130 - protein, 719 aa, Artificial Sequence; identical to SEQ ID NO: 54
  Synthetic Construct

SEQ ID NO: 131 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 132 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 133 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 134 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLSHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 135 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 136 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 137 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 138 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 139 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 140 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 141 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLDHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 142 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 143 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 144 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 145 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 146 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 147 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 148 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVQESESGSPDYQQQAAVPLQHETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 149 - protein, 715 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKD

SEQ ID NO: 150 - protein, 716 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDD

SEQ ID NO: 151 - protein, 717 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDD

SEQ ID NO: 152 - protein, 718 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDD

SEQ ID NO: 153 - protein, 719 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDD

SEQ ID NO: 154 - protein, 720 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDD

SEQ ID NO: 155 - protein, 721 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDD

SEQ ID NO: 156 - protein, 722 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDD

SEQ ID NO: 157 - protein, 723 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDD

SEQ ID NO: 158 - protein, 715 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKE

SEQ ID NO: 159 - protein, 719 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEEEEE

SEQ ID NO: 160 - protein, 724 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEEEEEEEEEE

SEQ ID NO: 161 - protein, 729 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEEEEEEEEEEEEEEE

SEQ ID NO: 162 - protein, 734 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEEEEEEEEEEEEEEEEEEEE

SEQ ID NO: 163 - protein, 717 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDS

SEQ ID NO: 164 - protein, 720 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDSDDS

SEQ ID NO: 165 - protein, 723 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDSDDSDDS

SEQ ID NO: 166 - protein, 717 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEES

SEQ ID NO: 167 - protein, 720 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEESEES

SEQ ID NO: 168 - protein, 723 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEESEESEES

SEQ ID NO: 169 - protein, 717 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDAD

SEQ ID NO: 170 - protein, 720 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDADDAD

SEQ ID NO: 171 - protein, 723 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDADDADDAD

SEQ ID NO: 172-174 - skipped (3 entries)

SEQ ID NO: 175 - protein, 723 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDD

SEQ ID NO: 176 - protein, 722 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDD

SEQ ID NO: 177 - protein, 721 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDD

SEQ ID NO: 178 - protein, 734 aa, Artificial Sequence
  Synthetic Construct
DSSEEKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - protein, 734 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEKFLRRIGRFG

SEQ ID NO: 180 - protein, 734 aa, Artificial Sequence
  Synthetic Construct
DDDEEKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - protein, 737 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDDDDDDKFLRRIGRFG

SEQ ID NO: 182 - protein, 737 aa, Artificial Sequence
  Synthetic Construct
DDDDDDDDKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - protein, 739 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDDDDDDDDKFLRRIGRFG

SEQ ID NO: 184 - protein, 739 aa, Artificial Sequence
  Synthetic Construct
DDDDDDDDDDKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 185 - protein, 737 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSEEEEEEEEKFLRRIGRFG

SEQ ID NO: 186 - protein, 737 aa, Artificial Sequence
  Synthetic Construct
EEEEEEEEKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 187 - protein, 736 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEEEKFLRRIGRFG

SEQ ID NO: 188 - protein, 736 aa, Artificial Sequence
  Synthetic Construct
DDDEEEEKFLRRIGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 189 - protein, 734 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEKFFRRFGRFG

SEQ ID NO: 190 - protein, 734 aa, Artificial Sequence
  Synthetic Construct
DDDEEKFFRRFGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 191 - protein, 738 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEKFLRRIRRFDGRFG

SEQ ID NO: 192 - protein, 738 aa, Artificial Sequence
  Synthetic Construct
DDDEEKFLRRIRRFDGRFGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 193 - protein, 738 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEKFLRRLRRFDGRYG

SEQ ID NO: 194 - protein, 738 aa, Artificial Sequence
  Synthetic Construct
DDDEEKFLRRLRRFDGRYGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 195 - protein, 739 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSDDDEEKFLRRLRRFDEGRYG

SEQ ID NO: 196 - protein, 739 aa, Artificial Sequence
  Synthetic Construct
DDDEEKFLRRLRRFDEGRYGGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 197 - protein, 732 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSKSDGGYYYTQSDY

SEQ ID NO: 198 - protein, 732 aa, Artificial Sequence
  Synthetic Construct
KSDGGYYYTQSDYGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 199 - protein, 733 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSTRYSYSTTPEEYDL

SEQ ID NO: 200 - protein, 733 aa, Artificial Sequence
  Synthetic Construct
TRYSYSTTPEEYDLGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 201 - protein, 735 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSTGGSSPFGGVAGVKDY

SEQ ID NO: 202 - protein, 735 aa, Artificial Sequence
  Synthetic Construct
TGGSSPFGGVAGVKDYGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 203 - protein, 731 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSVTKHLNQISQSY

SEQ ID NO: 204 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKVTKHLNQISQSY

SEQ ID NO: 205 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSKPRSVSG

SEQ ID NO: 206 - protein, 721 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKKPRSVSG

SEQ ID NO: 207 - protein, 731 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSNPYHPTIPQSVH

SEQ ID NO: 208 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKNPYHPTIPQSVH

SEQ ID NO: 209 - protein, 731 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSSVSVGMKPSPRP

SEQ ID NO: 210 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSVSVGMKPSPRP

SEQ ID NO: 211 - protein, 719 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGS

SEQ ID NO: 212 - protein, 714 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - protein, 730 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGSVTKHLNQISQSY

SEQ ID NO: 214 - protein, 725 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKVTKHLNQISQSY

SEQ ID NO: 215 - protein, 725 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGSKPRSVSG

SEQ ID NO: 216 - protein, 720 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKKPRSVSG

SEQ ID NO: 217 - protein, 730 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGSNPYHPTIPQSVH

SEQ ID NO: 218 - protein, 725 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKNPYHPTIPQSVH

SEQ ID NO: 219 - protein, 730 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGSSVSVGMKPSPRP

SEQ ID NO: 220 - protein, 725 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKSVSVGMKPSPRP

SEQ ID NO: 221 - protein, 718 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGS

SEQ ID NO: 222 - protein, 713 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGK

SEQ ID NO: 223 - protein, 728 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLSLSLGKGGGGSDDDDDDDDDD

SEQ ID NO: 224 - protein, 489 aa, Artificial Sequence
  Synthetic Construct
DDDDDDDDDDGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 225 - protein, 479 aa, Artificial Sequence
  Synthetic Construct
GGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 226 - protein, 489 aa, Artificial Sequence
  Synthetic Construct
EEEEEEEEEEGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 227 - protein, 491 aa, Artificial Sequence
  Synthetic Construct
CDDDDDDDDDDCGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 228 - protein, 491 aa, Artificial Sequence
  Synthetic Construct
VTKHLNQISQSYGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 229 - protein, 491 aa, Artificial Sequence
  Synthetic Construct
NPYHPTIPQSVHGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 230 - protein, 488 aa, Artificial Sequence
  Synthetic Construct
CNYPTLKSCGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 231 - protein, 488 aa, Artificial Sequence
  Synthetic Construct
CMLPHHGACGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 232 - protein, 491 aa, Artificial Sequence
  Synthetic Construct
SVSVGMKPSPRPGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGAVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 233 - protein, 486 aa, Artificial Sequence
  Synthetic Construct
KPRSVSGGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 234 - protein, 497 aa, Artificial Sequence
  Synthetic Construct
DDSWDTNDANVVCRQLGAGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 235 - protein, 491 aa, Artificial Sequence
  Synthetic Construct
KDVVVGVPGGQDGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 236 - protein, 488 aa, Artificial Sequence
  Synthetic Construct
EPRREVAELGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 237 - protein, 495 aa, Artificial Sequence
  Synthetic Construct
NPPTRQTKPKRVANTNGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 238 - protein, 494 aa, Artificial Sequence
  Synthetic Construct
DSSEEKFLRRIGRFGGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 239 - protein, 499 aa, Artificial Sequence
  Synthetic Construct
DDDDDDDDDDKFLRRIGRFGGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 240 - protein, 492 aa, Artificial Sequence
  Synthetic Construct
KSDGGYYYTQSDYGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 241 - protein, 597 aa, Artificial Sequence
  Synthetic Construct
QVQLVESGGGLVQAGGSLRLSCAASGRTRVMGWFRQAPGKEREFVAAIGRSGTTRYADSVKGRFTISRDNGKNTVYLQMNNLKPEDTAVYYCAAKSDGGYYYTQSDYWGQGTQVTVSSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 242 - protein, 601 aa, Artificial Sequence
  Synthetic Construct
QVKLEESGGGLVQAGGSLRLSCAASGRTFSTYSMGWFRRAPGKEREFVAAISWSGGTTRYTNSVKGRFTISKDNFGNTVYLQMNNLKPEDTAVYYCATRYSYSTTPEEYDLWGQGNQVTVSSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 243 - protein, 603 aa, Artificial Sequence
  Synthetic Construct
QVQLQESGGGLVQPGGSLRLSCSASGFSLDIYAIGWFRQAPGKEREGVSCINSSGSSTYYADSVKGRFTISRDNAKNTIYLQMNSLKPEDTAVYYCATGGCSPFGGVAGVKDYWGQGTQVTVSSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 244 - protein, 603 aa, Artificial Sequence
  Synthetic Construct
QVQLVESGGGLVQAGGSLRLSCAASGRTRVMGWFRQAPGKEREFVAAIGDDDDDDDDDDTRYADSVKGRFTISRDNGKNTVYLQMNNLKPEDTAVYYCAAKSDGGYYYTQSDYWGQGTQVTVSSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 245 - protein, 632 aa, Artificial Sequence
  Synthetic Construct
MDWTWRVFCLLAVAPGAHSDDDDDDDDDDQVQLQESGGGLVQPGGSLRLSCSASGFSLDIYAIGWFRQAPGKEREGVSCINSSGSSTYYADSVKGRFTISRDNAKNTIYLQMNSLKPEDTAVYYCATGGCSPFGGVAGVKDYWGQGTQVTVSSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSVGEDSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHAQMALKLVGGGYLHCSLKTTYRSKKPAKNLKMPGFYFVDRRLERIKEADKETYVEQHEMAVARYCDLPSKLGHSGSHHHHHH

SEQ ID NO: 246 - protein, 248 aa, Mesorhizobium loti
MTERLAGKTALVTGAAQGIGKAIAARLAADGATVIVSDINAEGAKAAAASIGKKARAIAADISDPGSVKALFAEIQALTGGIDILVNNASIVPFVAWDDVDLDHWRKIIDVNLTGTFIVTRAGTDQMRAAGKAGRVISIASNTFFAGTPNMAAYVAAKGGVIGFTRALATELGKYNITANAVTPGLIESDGVKASPHNEAFGFVEMLQAMKGKGQPEHIADVVSFLASDDARWITGQTLNVDAGMVRH

SEQ ID NO: 247 - protein, 719 aa, Artificial Sequence
  Synthetic Construct
VIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCQTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGARYVWQRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSEETHGGEDVAVFARGPQAHLVHGVQEQSFVAHVMAFAACLEPYTACDLAPPAGTTDAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 248 - protein, 126 aa, Artificial Sequence
  Synthetic Construct
QVQLVESGGGLVQAGGSLRLSCAASGRTRVMGWFRQAPGKEREFVAAIGRSGTTRYADSVKGRFTISRDNGKNTVYLQMNNLKPEDTAVYYCAAKSDGGYYYTQSDYWGQGTQVTVSSGSHHHHHH

SEQ ID NO: 249 - protein, 129 aa, Artificial Sequence
  Synthetic Construct
QVQLVESGGGLVQAGGSLRLSCAASGRTRVMGWFRQAPGKEREFVAAIGDDDDDDDTRYADSVKGRFTISRDNGKNTVYLQMNNLKPEDTAVYYCAAKSDGGYYYTQSDYWGQGTQVTVSSGSHHHHHH

SEQ ID NO: 250 - protein, 129 aa, Artificial Sequence
  Synthetic Construct
QVQLVESGGGLVQAGGSLRLSCAASGRTRVMGWFRQAPGKEREFVAAIGDDDDDDDTRYADSVKGRFTISRDNGKNTVYLQMNNLKPEDTAVYYCAADDDDDDDDDDDDYWGQGTQVTVSSGSHHHHHH

SEQ ID NO: 251 - protein, 17 aa, Homo sapiens
MISPFLVLAIGTCLTNS

SEQ ID NO: 252 - protein, 15 aa, Homo sapiens
DDSEEKFLRRIGRFG

SEQ ID NO: 253 - protein, 223 aa, Homo sapiens
VECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 254 - protein, 5 aa, Artificial Sequence
  Synthetic Construct
GGGGS

SEQ ID NO: 255 - protein, 15 aa, Artificial Sequence
  Synthetic Construct
GGGGAGGGGAGGGGS

SEQ ID NO: 256 - protein, 15 aa, Artificial Sequence
  Synthetic Construct
GGGGQGGGGQGGGGS

SEQ ID NO: 257 - protein, 15 aa, Artificial Sequence
  Synthetic Construct
GGGPSGGGPSGGGGS

SEQ ID NO: 258 - protein, 15 aa, Artificial Sequence
  Synthetic Construct
GGGGSPGGGSPGGGS

SEQ ID NO: 259 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 742 aa, Homo sapiens
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASS

SEQ ID NO: 261 - protein, 491 aa, Homo sapiens
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAA

SEQ ID NO: 262 - protein, 736 aa, Artificial Sequence
  Synthetic Construct
EEEEEEEEKFLRRIGRFGGGGSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 263 - protein, 743 aa, Artificial Sequence
  Synthetic Construct
MDWTWRVFCLLAVAPGAHSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKQKTDVEYESDEKARGTRLDGLDLVDTWKSFKPRYKHSHFIWNRTELLTLDPHNVDYLLGLFEPGDMQYELNRNQVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDDDDD

SEQ ID NO: 264 - protein, 740 aa, Artificial Sequence
  Synthetic Construct
MDWTWRVFCLLAVAPGAHSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANMGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKDDDDDDD

SEQ ID NO: 265 - DNA, 2238 bp, Artificial Sequence
  Synthetic Construct
atggattggacttggagggtgttctgcctgctggccgtcgcccctggcgcacacagcctcgtgcccgagaaggagaaggatccgaagtactggagagatcaggcgcaggaaaccctgaaatacgccttggagctgcagaagttgaacaccaacgtggctaagaacgtgatcatgttcctgggcgacgggatgggagtctccactgtgacggccgctcggatcctgaaggggcagctccaccataatcccggagaagaaactcggctggagatggacaagttcccatttgtggcgctgtccaagacctacaacactaatgcacaggtgcccgactccgcggggaccgccaccgcttacctctgcggagtgaaggccaacatgggcaccgtgggcgtcagcgcggccaccgaaagatcacggtgcaataccacccagggaaacgaagtgaccagcatccttaggtgggccaaggatgccgggaagtccgtgggaatcgtgaccacgacccgggtgaaccacgccaccccaagcgccgcctacgcccacagcgccgacagggactggtactccgacaacgagatgcccccagaagccctgagccagggttgcaaggacatcgcgtaccaactgatgcacaacatccgcgatatcgatgtgatcatgggaggaggtcgcaagtacatgtatccgaagcagaagaccgatgtggagtacgagtccgacgaaaaggcccgcggaactagactggatggactcgaccttgtggacacctggaagtcgtttaagccgcgctacaagcactcacacttcatctggaatcgcactgaactcctgaccctggacccccacaacgtggattacctgttgggacttttcgagcccggcgacatgcagtacgagctgaacagaaaccaggtgaccgacccttcactgtccgaaatggtggtggtcgcaatccagattttgcggaagaacccaaagggctttttcctgttggtggaagggggacgaatcgaccacggacaccacgaaggaaaggctaagcaggccctgcacgaggccgtcgaaatggatagagcgattggacaggccggttcgctgacttcctccgaggacactctgaccgtcgtgaccgcggaccattcccacgtctttaccttcggtggttacactccgcgcggcaactcaatcttcggactcgctcccatgctgtccgataccgacaagaagcctttcaccgcaattttgtatggaaatggaccgggctacaaggtcgtcggtggagaaagagagaacgtgtccatggtggattacgcgcacaacaactatcaggcccagtcggccgtccccctgcggcatgaaacccacggtggagaggacgtcgccgtgttctccaagggccccatggcccacctgttgcacggcgtgcatgaacagaactacgtgccacacgtgatggcgtatgccgcgtgtataggggcgaacctcggccattgcgcacctgccagctccgccggatccctcgccgccgtggagtgcccgccctgccccgcaccgcctgtggcaggcccgtccgtgttcctgttcccgcctaagccgaaggacaccctcatgatctcgcgcaccccggaggtcacctgtgtggtcgtggacgtgtcgcaggaggaccctgaagtccagttcaattggtacgtggacggcgtggaagtgcataacgccaagaccaagccgcgggaggaacagttcaactctacttaccgggtggtgtcggtgcttactgtgttgcaccaagattggctcaacggcaaagagtacaagtgcaaagtgtccaacaagggccttccgtcctccattgaaaagaccatctccaaggccaaggggcagcctagagaaccacaggtctacacactgcctccatcgcaagaagaaatgaccaagaaccaagtgtccctgacttgcctcgtgaaagggttctatccgtcggacatcgccgtcgaatgggaatcaaacggtcaaccagagaacaactacaagaccacccctcctgtgctggacagcgacggctcgttcttcctgtactcccggctgactgtggacaagtcccggtggcaggagggaaacgtgttctcatgttcagtgatgcatgaggcgctgcataaccactacactcaaaagagcctgagcctctccctgggaaaggacgatgatgacgacgacgatgacgatgattgatagtaa

SEQ ID NO: 266 - DNA, 2225 bp, Homo sapiens
attggacttggagggtgttctgcctgctggccgtcgcccctggcgcacacagcctcgtgcccgagaaggagaaggatccgaagtactggagagatcaggcgcaggaaaccctgaaatacgccttggagctgcagaagttgaacaccaacgtggctaagaacgtgatcatgttcctgggcgacgggatgggagtctccactgtgacggccgctcggatcctgaaggggcagctccaccataatcccggagaagaaactcggctggagatggacaagttcccatttgtggcgctgtccaagacctacaacactaatgcacaggtgcccgactccgcggggaccgccaccgcttacctctgcggagtgaaggccaacgaaggcaccgtgggcgtcagcgcggccaccgaaagatcacggtgcaataccacccagggaaacgaagtgaccagcatccttaggtgggccaaggatgccgggaagtccgtgggaatcgtgaccacgacccgggtgaaccacgccaccccaagcgccgcctacgcccacagcgccgacagggactggtactccgacaacgagatgcccccagaagccctgagccagggttgcaaggacatcgcgtaccaactgatgcacaacatccgcgatatcgatgtgatcatgggaggaggtcgcaagtacatgtatccgaagaacaagaccgatgtggagtacgagtccgacgaaaaggcccgcggaactagactggatggactcgaccttgtggacacctggaagtcgtttaagccgcgctacaagcactcacacttcatctggaatcgcactgaactcctgaccctggacccccacaacgtggattacctgttgggacttttcgagcccggcgacatgcagtacgagctgaacagaaacaacgtgaccgacccttcactgtccgaaatggtggtggtcgcaatccagattttgcggaagaacccaaagggctttttcctgttggtggaagggggacgaatcgaccacggacaccacgaaggaaaggctaagcaggccctgcacgaggccgtcgaaatggatagagcgattggacaggccggttcgctgacttcctccgaggacactctgaccgtcgtgaccgcggaccattcccacgtctttaccttcggtggttacactccgcgcggcaactcaatcttcggactcgctcccatgctgtccgataccgacaagaagcctttcaccgcaattttgtatggaaatggaccgggctacaaggtcgtcggtggagaaagagagaacgtgtccatggtggattacgcgcacaacaactatcaggcccagtcggccgtccccctgcggcatgaaacccacggtggagaggacgtcgccgtgttctccaagggccccatggcccacctgttgcacggcgtgcatgaacagaactacgtgccacacgtgatggcgtatgccgcgtgtataggggcgaacctcggccattgcgcacctgccagctccgccggatccctcgccgccgtggagtgcccgccctgccccgcaccgcctgtggcaggcccgtccgtgttcctgttcccgcctaagccgaaggacaccctcatgatctcgcgcaccccggaggtcacctgtgtggtcgtggacgtgtcgcaggaggaccctgaagtccagttcaattggtacgtggacggcgtggaagtgcataacgccaagaccaagccgcgggaggaacagttcaactctacttaccgggtggtgtcggtgcttactgtgttgcaccaagattggctcaacggcaaagagtacaagtgcaaagtgtccaacaagggccttccgtcctccattgaaaagaccatctccaaggccaaggggcagcctagagaaccacaggtctacacactgcctccatcgcaagaagaaatgaccaagaaccaagtgtccctgacttgcctcgtgaaagggttctatccgtcggacatcgccgtcgaatgggaatcaaacggtcaaccagagaacaactacaagaccacccctcctgtgctggacagcgacggctcgttcttcctgtactcccggctgactgtggacaagtcccggtggcaggagggaaacgtgttctcatgttcagtgatgcatgaggcgctgcataaccactacactcaaaagagcctgagcctctccctgggaaaggacgatgatgacgacgacgatgacgatgat

SEQ ID NO: 267 - DNA, 2229 bp, Artificial Sequence
  Synthetic Construct
agcttatggattggacttggagggtgttctgcctgctggccgtcgcccctggcgcacacagcgtgattcccgctgaggaggagaacccggccttttggaatagacaggcggccgaggccctggatgcggcgaagaagttgcagcccatccagaaagtggctaagaacctgattcttttcctgggcgacgggctgggagtccctactgtgacggccacccggatcctgaaggggcagaagaacggaaagctcggaccggaaactcctctggccatggaccggttcccatacctggcgctgtccaagacctacaacgtcgaccgccaagtgcccgactccgctgccaccgccaccgcttacctctgcggagtgaaggctaacttccaaaccatcggcctgagcgcggccgcccggttcaaccagtgcaataccacccgcggaaacgaagtgatctccgtgatgaacagggccaagcaggccgggaagtccgtgggagtcgtgaccacgacccgggtgcagcacgccagccctgccggaacctacgcccacacggtcaacaggaactggtactccgacgccgacatgccagccagcgctcggcaggaaggttgccaggacatcgcgacccaactgatttccaacatggatatcgatgtgatcctgggaggaggtcgcaagtacatgtttccgatgggtacccccgatcccgagtaccccgccgacgccagccagaacggtatcagactggatggaaagaaccttgtgcaggaatggctcgccaagcaccagggggcccggtacgtctggaatcgcactgaactcatgcaagccagcctggaccagtcagtgactcacttgatgggacttttcgagcccggcgacaccaaatacgagatccatagagacccgaccctggacccttcactgatggaaatgaccgaagccgcattgagactcctgtcgcggaacccaagaggcttttacctgttcgtggaagggggacgaatcgaccacggacaccacgaaggggtcgcttaccaagccctgactgaagctgtgatgttcgacgatgcgattgagcgggccggacagctgacttccgaagaggacactctgaccctcgtgaccgcggaccattcccacgtgttttctttcggtggttacaccctgcgcggctcgtcaatcttcggactcgctccctcaaaagcgcaggactcgaaggcatacacctccattttgtatggaaatggaccgggctacgtctttaattcgggtgtcagaccggacgtccaagagtccgagagcgggtcccccgactatcagcagcaggccgccgtccccctggaccacgaaacccacggcggagaggacgtcgccgtgttcgcccgcggcccccaagcccacctggtgcacggcgtgcaggaacagtccttcgtggcccacgtgatggcgttcgccgcgtgtctcgagccgtacacagcctgcgacctggcacctccggccggcaccactgatgccgccgtggagtgcccgccctgccccgcaccgcctgtggcaggcccgtccgtgttcctgttcccgcctaagccgaaggacaccctcatgatctcgcgcaccccggaggtcacctgtgtggtcgtggacgtgtcgcaggaggaccctgaagtccagttcaattggtacgtggacggcgtggaagtgcataacgccaagaccaagccgcgggaggaacagttcaactctacttaccgggtggtgtcggtgcttactgtgttgcaccaagattggctcaacggcaaagagtacaagtgcaaagtgtccaacaagggccttccgtcctccattgaaaagaccatctccaaggccaaggggcagcctagagaaccacaggtctacacactgcctccatcgcaagaagaaatgaccaagaaccaagtgtccctgacttgcctcgtgaaagggttctatccgtcggacatcgccgtcgaatgggaatcaaacggtcaaccagagaacaactacaagaccacccctcctgtgctggacagcgacggctcgttcttcctgtactcccggctgactgtggacaagtcccggtggcaggagggaaacgtgttctcatgttcagtgatgcatgaggcgctgcataaccactacactcaaaagagcctgagcctctccctgggaaaggacgatgatgacgacgacgatgacgatgattgatagtaag

SEQ ID NO: 268 - DNA, 2166 bp, Artificial Sequence
  Synthetic Construct
ctggtgcctgagaaagagaaggaccccaagtattggagagatcaggcccaagagacactgaagtacgccctggaactgcagaaactgaacaccaacgtggccaagaacgtgatcatgttcctcggcgacggcatgggcgttagcacagtgacagccgccagaatcctgaagggccagctgcaccataatcctggcgaagagacacggctggaaatggacaagttccccttcgtggccctgtccaagacctacaacacaaacgcccaggtgccagattctgccggcacagccacagcttatctgtgcggcgtgaaggccaatatgggcacagtgggagtgtctgccgccaccgagagaagcagatgtaacaccactcagggcaacgaagtgaccagcatcctgagatgggccaaagatgccggcaagagcgtgggcatcgtgaccaccacaagagtgaatcacgccacacctagcgccgcctatgctcactctgccgacagagactggtacagcgacaacgagatgcctcctgaggctctgtctcagggctgcaaggatatcgcctaccagctgatgcacaacatccgggatatcgatgtgatcatgggcggaggccggaagtacatgtatcccaagaacaagaccgacgtcgagtacgagagcgacgagaaggccagaggcacaagactggatggcctggatctggtggacacctggaagtccttcaagcccagatacaagcactctcacttcatctggaaccggaccgagctgctgaccctggatcctcacaatgtggattacctgctgggcctgttcgagcccggcgatatgcagtacgagctgaaccggaacaacgtgacagaccccagcctgtctgaaatggtggtggtggccattcagatcctgcggaagaaccccaagggattcttcctgctggtggaaggcggaagaatcgaccacggacaccacgagggaaaagccaaacaggccctgcacgaggccgttgagatggatagagccattggacaggccggcagcctgacaagctctgaggatacactgaccgtggtcaccgccgatcacagccacgtgttcacatttggcggctacacccctcggggcaactccatttttggactggcccctatgctgagcgacaccgacaagaagcctttcaccgccatcctgtatggcaacggccctggctacaaagttgttggcggcgagagggaaaacgtgtccatggtggactacgcccacaacaactaccaggctcagtctgccgtgcctctgagacacgaaacacacggcggagaggatgtggccgtgttttctaagggccccatggctcatctgctgcacggcgtgcacgagcagaattacgtgccacatgtgatggcctacgccgcctgtattggagccaatctgggacattgtgcccctgccagttctgctggatctctggctgctgtggaatgccctccttgtcctgctcctccagtggccggaccttccgtgtttctgttccctccaaagcctaaggacaccctgatgatcagcagaacccctgaagtgacctgcgtggtggtcgacgtttcccaagaggatcccgaggtgcagttcaattggtacgtggacggcgtggaagtgcacaacgccaagaccaagcctagagaggaacagttcaacagcacctacagagtggtgtctgtgctgaccgtgctgcaccaggactggctgaacggcaaagagtacaagtgcaaggtgtccaacaagggcctgcctagcagcatcgagaaaaccatcagcaaggccaagggacagcccagagaaccccaggtttacaccctgcctccaagccaagaggaaatgaccaagaatcaggtgtccctgacctgcctggtcaagggcttctacccttccgatatcgccgtggaatgggagagcaatggccagcctgagaacaactacaagaccacacctcctgtgctggacagcgacggcagcttttttctgtactcccggctgacagtggacaagagcagatggcaagagggcaacgtgttcagctgcagcgtgatgcacgaagccctgcacaaccactacacccagaagtctctgagcctgtctctgggcaaagacgacgatgacgacgacgattga

SEQ ID NO: 269 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

The invention claimed is:

1. A polypeptide comprising: (1) a recombinant alkaline phosphatase having at least one mutation selected from the group consisting of E108S, E108T, E108Q, E108M, E108K, E108L, M384R, and L385T relative to SEQ ID NO: 1 and (2) a bone targeting moiety comprising from 3 to 30 consecutive aspartate or glutamate residues, wherein the polypeptide comprises an amino acid sequence with at least 90% sequence identity to any one of SEQ ID NOs: 72, 123, 155, or 177, wherein the original residue before mutation is shown in SEQ ID NO: 1, and the position numbers are relative to SEQ ID NOs: 1, 72, 123, 155, and 177.

2. The polypeptide of claim 1, wherein the polypeptide further comprises a fragment crystallizable (Fc) region of an immunoglobulin.

3. The polypeptide of claim 2, wherein the Fc region comprises IgG1, IgG2, IgG3, or IgG4, or a chimera thereof.

4. The polypeptide of claim 3, wherein the Fc region comprises an IgG2/4 chimera.

5. The polypeptide of claim 4, wherein the Fc region comprises the sequence of SEQ ID NO: 253 or has at least 85% sequence identity thereto.

6. The polypeptide of claim 1, wherein the polypeptide comprises an amino acid sequence having at least 95% sequence identity to any one of SEQ ID NOs: 72, 123, 155, or 177.

7. The polypeptide of claim 1, wherein the bone targeting moiety comprises Dn or En, wherein n=7 to 10.

8. The polypeptide of claim 7, wherein the bone targeting moiety is

Dn and n=7 to 10.

9. A pharmaceutical composition comprising the polypeptide of claim 1 and a pharmaceutically acceptable carrier.

10. The pharmaceutical composition of claim 9, wherein:
(a) the pharmaceutically acceptable carrier comprises sodium chloride and/or sodium phosphate;
(b) the composition comprises the polypeptide at a dosage of from 0.1 mg/ml to 10 mg/mL; and/or
(c) the composition is formulated in a volume of 0.1 mL to 50 mL.

11. The polypeptide of claim 1, wherein the recombinant alkaline phosphatase has at least two, three, four, or five mutations selected from the group consisting of E108S, E108T, E108Q, E108M, E108K, E108L, M384R, and L385T relative to SEQ ID NO: 1.

12. The polypeptide of claim 6, wherein the polypeptide comprises an amino acid sequence having at least 97% sequence identity to any one of SEQ ID NOs: 72, 123, 155, or 177.

13. The polypeptide of claim 12, wherein the polypeptide comprises an amino acid sequence having at least 99% sequence identity to any one of SEQ ID NOs: 72, 123, 155, or 177.

14. The polypeptide of claim 13, wherein the polypeptide comprises the amino acid sequence of any one of SEQ ID NOs: 72, 123, 155, or 177.

15. The polypeptide of claim 14, wherein the polypeptide consists of the amino acid sequence of any one of SEQ ID NOs: 72, 123, 155, or 177.

16. The polypeptide of claim 14, wherein the polypeptide comprises the amino acid sequence of SEQ ID NO: 123.

17. The polypeptide of claim 16, wherein the polypeptide consists of the amino acid sequence of SEQ ID NO: 123.

* * * * *